United States Patent
Liu et al.

(10) Patent No.: US 11,525,144 B2
(45) Date of Patent: Dec. 13, 2022

(54) INSECTICIDAL PROTEINS FROM PLANTS AND METHODS FOR THEIR USE

(71) Applicants: PIONEER HI-BRED INTERNATIONAL, INC., Johnston, IA (US); HEXIMA LIMITED, Melbourne (AU)

(72) Inventors: Lu Liu, Palo Alto, CA (US); Amy Lum, Hayward, CA (US); Azalea S. Ong, Castro Valley, CA (US); Eric Schepers, Port Deposit, MD (US); Ingrid Udranszky, Mountain View, CA (US); Xiaohong Zhong, San Leandro, CA (US)

(73) Assignees: PIONEER HI-BRED INTERNATIONAL, INC., Johnston, IA (US); HEXIMA LIMITED, Melbourne (AU)

( * ) Notice: Subject to any disclaimer, the term of this patent is extended or adjusted under 35 U.S.C. 154(b) by 0 days.

(21) Appl. No.: 16/980,087

(22) PCT Filed: Mar. 12, 2019

(86) PCT No.: PCT/US2019/021775
§ 371 (c)(1),
(2) Date: Sep. 11, 2020

(87) PCT Pub. No.: WO2019/178042
PCT Pub. Date: Sep. 19, 2019

(65) Prior Publication Data
US 2021/0017241 A1    Jan. 21, 2021

Related U.S. Application Data

(60) Provisional application No. 62/642,642, filed on Mar. 14, 2018.

(51) Int. Cl.
*C12N 15/82* (2006.01)
*A01N 63/50* (2020.01)
*C07K 14/415* (2006.01)

(52) U.S. Cl.
CPC .......... *C12N 15/8286* (2013.01); *A01N 63/50* (2020.01); *C07K 14/415* (2013.01); *C07K 2319/00* (2013.01)

(58) Field of Classification Search
CPC .......................... C12N 15/8286; C07K 14/415
See application file for complete search history.

(56) References Cited

U.S. PATENT DOCUMENTS

2018/0066277 A1    3/2018    Parks et al.

FOREIGN PATENT DOCUMENTS

| WO | 2013/098858 | 7/2013 |
|---|---|---|
| WO | 2015/120270 | 8/2015 |
| WO | 2016/061206 | 4/2016 |
| WO | 2016/075710 | 5/2016 |
| WO | WO2016/144686 | 9/2016 |
| WO | 2018/005411 | 1/2018 |

OTHER PUBLICATIONS

Shen et al (The fern-feeding genus Cuprina sinev, 1988 (Lepidoptera, Stathmopodidae), new for Taiwan, with descriptions of two new species. ZooKeys 915: 117-126, 2020) (Year: 2020).*
WP_049582733_EL774105 (Year: 2009).*
Friedberg (Automated protein function prediction—the genomic challenge. Brief. Bioinformatics. 7:225-242, 2006) (Year: 2006).*
Wang et al (From Protein Sequence to Protein Function via Multi-Label Linear Discriminant Analysis. IEEE/ACM Transactions on Computational Biology and Bioinformatics, vol. 14, No. 3, 503-513, 2017) (Year: 2017).*
Bruce et al (The paradox of plastid transit peptides: conservation of function despite divergence in primary structure. Biochimica et Biophysica Acta 1541 2-21, 2001) (Year: 2001).*
PCT Search Report and Written Opinion prepared for PCT/US2019/021775, completed May 17, 2019.
Shukla, et al., "Expression of an Insecticidal Fern Protein in Cotton Protects Against Whitefly," 2016, Nature Biotechnology, vol. 34, pp. 1046-1051. (Abstract Only).
Aguirre La, et al., "Genetically Modified Maize Resistant to Corn Earworm (*Lepidoptera: Noctuidae*) in Sinaloa, Mexico," Aug. 31, 2015, The Florida Entomologist, vol. 98, No. 3, pp. 821-826. (Abstract Only).

* cited by examiner

*Primary Examiner* — Charles Logsdon
*Assistant Examiner* — Wayne Zhong
(74) *Attorney, Agent, or Firm* — Barnes & Thornburg LLP

(57) ABSTRACT

Compositions and methods for controlling pests are provided. The methods involve transforming organisms with a nucleic acid sequence encoding an insecticidal protein. In particular, the nucleic acid sequences are useful for preparing plants and microorganisms that possess insecticidal activity. Thus, transformed bacteria, plants, plant cells, plant tissues and seeds are provided. Compositions are insecticidal nucleic acids and proteins of bacterial species. The sequences find use in the construction of expression vectors for subsequent transformation into organisms of interest including plants, as probes for the isolation of other homologous (or partially homologous) genes. The pesticidal proteins find use in controlling, inhibiting growth or killing Lepidopteran, Coleopteran, Dipteran, fungal, Hemipteran and nematode pest populations and for producing compositions with insecticidal activity.

21 Claims, 23 Drawing Sheets
Specification includes a Sequence Listing.

Fig. 2A

```
                      1                                                    50
IPD113Aa      (1)    MDSDLI▓▓▓D▓NAASV▓APAAEKVQE▓▓▓▓---▓▓▓▓▓▓▓DSDVDPQFE
IPD113Ab      (1)    MDSDLI▓▓▓D▓NAASV▓APAAEKVQE▓▓▓▓---▓▓▓▓▓▓▓DSDVDPQFE
IPD113Bb      (1)    MDSDLI▓▓▓D▓NAASV▓APAAEKVEE▓▓▓▓---▓▓▓▓▓▓▓DSDVDPQFE
IPD113Bc      (1)    MDSDLI▓▓▓D▓NAASV▓APAAEKVEE▓▓▓▓---▓▓▓▓▓▓▓DSDVDPQFE
IPD113Db      (1)    ------MAA▓G▓▓TVS▓▓APATDKVQN----------▓▓MAE▓DP▓F▓
IPD113Dh      (1)    ------MAA▓D▓NTVSE▓APAAD▓▓EQ▓▓▓-------▓▓▓AE▓DP▓F▓
IPD113Ei      (1)    ------MAA▓EAK▓AG▓▓VATT▓A▓EE▓▓▓▓▓LA▓▓▓▓▓▓QEA▓▓DP▓F▓
IPD113Ej      (1)    ------MAA▓EAK▓AG▓▓VATT▓▓▓EEVQKNDLA▓▓AV▓MQEA▓▓DP▓FA
IPD113Fl      (1)    ------MAA▓G▓▓AEDV▓AS▓AE▓▓EN▓▓▓▓▓LA▓▓▓▓▓▓MG▓GG▓L▓G▓
IPD113Fa      (1)    ------MAA▓G▓MSSAV▓▓ADG▓▓▓N▓▓APAA▓▓EG▓▓VVEDHG▓▓▓L▓
IPD113Gg      (1)    ---------------------------------------------------
IPD113Gh      (1)    ---------------------------------------------------

51                                                   100
IPD113Aa     (48)    QEMINISALIAAGAVEGHDDVDLFAKYMQVEAHDW▓NRL▓R▓AILGLT▓AI
IPD113Ab     (49)    QEMINISALIAAGAVEGHDDLDLFAKYMQVDAHDWHNRL▓R▓AILGLT▓AI
IPD113Bb     (49)    QEMNNISALIAAGAVEGHDDVDLFAKYMQVEAHDWHNRL▓R▓AILGLT▓AI
IPD113Bc     (49)    QEMKNISALIAAGAVEGHDDVDLFAKYMQVEAHDWHNRL▓R▓AILGLT▓AI
IPD113Db     (33)    Q▓A▓▓MAA▓▓▓▓---E▓▓▓▓VDL▓AQYMQVEAHDWHNRVR▓AILGL▓SAV
IPD113Dh     (36)    Q▓▓▓▓MAA▓▓▓▓K---E▓▓A▓VDL▓AQYMQVEAHDWHNRIR▓AILGL▓SAV
IPD113Ei     (45)    Q▓▓▓▓MQA▓▓▓▓▓G▓▓E---▓▓▓VDL▓DKYMQV▓AHDWHNRIR▓AILGL▓S▓V
IPD113Ej     (45)    Q▓▓▓▓MQA▓▓▓AV▓G▓E---▓▓▓VDL▓▓KYMQV▓AHDWHNRIR▓AILGL▓S▓V
IPD113Fl     (45)    ▓▓▓V▓▓S▓▓▓▓▓▓AG▓▓LDA▓VE▓▓FARN▓QMEAHDWHNR▓R▓VVLAL▓S▓I
IPD113Fa     (45)    ▓▓▓▓▓▓AEVER▓▓▓▓VVEQ▓▓▓▓LQLE▓▓YIQVN▓ADDWHNRIR▓AILQLASGI
IPD113Gg      (1)    -------------▓▓S▓▓VAVS▓▓▓T▓VDV▓A▓DW▓NRIRDTVM▓ISS▓I
IPD113Gh      (1)    -------------▓▓S▓▓VAVS▓▓▓T▓VDV▓A▓DWNNRIR▓TVM▓ISS▓I 101                                                  150
IPD113Aa     (98)    PNP▓VG▓AIS▓FI▓L▓WPANKV▓IWEALNAEQYI▓NIVQQEL▓QFEMR▓L
IPD113Ab     (99)    PNPVVG▓AIS▓FI▓LIWP▓NKV▓IW▓ALNAEQYI▓NIVQQEL▓Q▓EMR▓L
IPD113Bb     (99)    PNP▓VG▓AIS▓FI▓LIWPANKV▓IWEALNAEQYIRNIVQQEL▓QFEMR▓L
IPD113Bc     (99)    PNP▓VG▓AIS▓FI▓LIWPANKV▓IWEALNAEQYIRNIVQQEL▓QFEMR▓L
IPD113Db     (79)    P--▓VG▓AIS▓LIGLFWPANKVDIWEAL▓AE▓YIRNIVQQELFEFEMR▓L
IPD113Dh     (82)    P--▓VG▓AIS▓LIGLFWP▓NKVDIWEALNAE▓YIRNIVQQELFEFEM▓▓L
IPD113Ei     (94)    P--VVG▓GVS▓LVGLFWPTTKVDIWEAL▓▓EQYIRNIVQQE▓FEFEMR▓L
IPD113Ej     (94)    P--VVG▓GVS▓LVGLFWPTTKVDIWEAL▓▓EQYIRNIVQQE▓FEFEMR▓L
IPD113Fl     (95)    P--▓VG▓▓AS▓VLGIFWPANKVDIW▓AL▓▓EEYVRNIV▓QE▓FEFEMR▓▓
IPD113Fa     (95)    P--VVGN▓AVS▓LLGLFWPANR▓VNI▓E▓I▓▓EQYIRNIV▓QE▓FEFE▓R▓▓
IPD113Gg     (38)    P--▓VG▓AVVS▓▓IIG▓FWP▓NK▓DV▓QAL▓AD--L▓KLV▓KEI▓LEFEL▓▓▓
IPD113Gh     (38)    P--▓VG▓VVS▓IIG▓FWP▓NK▓DV▓QAL▓AD--L▓KLV▓KEI▓LEFEL▓▓▓
```

Fig. 2B

```
              151                                                  200
IPD113Aa (148) QSRIEALQTTIIRYDQAAAIEKGNFLSIWITQADGLLIMRNSSNRIHL
IPD113Ab (149) QSRIEALQTTIIRYDQAAAIEKGTFLSIWISQADGLLIMRNSSNRIHL
IPD113Bb (149) QSQIETLQTTIIRYDQAAAIEKGNFLSIWISQADGLFIMRNSSNRIHL
IPD113Bc (149) QSQIETLQTTIIRYDQAAAIEKGNFLSIWISQADGLFIMRNSSNRIHL
IPD113Db (127) ENDIQALETTVIRYDIAAIIE-KGNFLSIWISQADALYIRMRNSTNNIHL
IPD113Dh (130) QNDIQALETTVIRYDIAAIIE-KGNFLSIWISQADALYIRMRNSTNNIHL
IPD113Ei (142) QSDIIALETTVIRYDIATSIIEKGNFLSIWITQADALYIRMRDSTNNIHL
IPD113Ej (142) QSDIIALETTVIRYDIATSIIEKGNFLSIWITQADALYIRMRDSTNNIHL
IPD113Fl (143) QSSIEALESTIIRYNIAAIIE-KGNFLSIWISQADALIRLRMSTNDIHL
IPD113Fa (143) MSDIEALEITVISYDIAAIRE-KGNFLTIWITQSNILIRLRNSINNIHL
IPD113Gg  (84) QSEIDALKIIIRYKIAINIE-KAIFLNIWITEADILIIFRQSTNNIHL
IPD113Gh  (84) QSEIDALKIIIRYKIAINIE-KAIFLNIWITEADILIIFRQSTNNIHL 201                                                  250
IPD113Aa (198) LLHIVTVAALHMAALHERLTFGEELYGINDTASWIRALVEMFEIYTIKLI
IPD113Ab (199) LLHIVTVAVLHMAALHERLTFGEELYGINDTASWKRALVEMFEIYTIKLI
IPD113Bb (199) LLHIVTVATLHMAALHERLSFGKELYGIDDTASWIRALIQMFEIYTIKLI
IPD113Bc (199) LLHIVTVATLHMAALHERLSFGKELYGIDDTASWKRALIQMFEIYTIKLI
IPD113Db (176) LLHMVTVSTLHIAALHERLTFGEELYGINNSTNWIRDLVDIFEIYTIDLI
IPD113Dh (179) LLHMVTVSTLHIAALHERLTFGEELYGINNAANWIQDLVDIFEIYTIDLI
IPD113Ei (192) LLHIVTVSTLHIAALHERLTFGEELYGINNAANWIRDLVDIFRIYTVDLI
IPD113Ej (192) LLHIVTVSTLHIAALHERLTFGEELYGINNAANWIRDLVDIFKIYTVDLL
IPD113Fl (192) LLHIVTVSVLHMAAIHERLTFGEELYGIDNTANWIRDLVEVFQIYTIDLI
IPD113Fa (192) LLHIVTVATLHMAALHERITFGKELYAIDNTINWIEDLVIIFRIYAIEVL
IPD113Gg (133) ILIVINLAVLHLTGLEERLIFGKELYDIDNTIRWIEDLIEMYKIYVDFL
IPD113Gh (133) ILIVINLAVLHLTGLEERLIFGKELYDIDNTIRWKEDLIEMYKIYVVDFL 251                                                  300
IPD113Aa (248) PTIFKEWRIWREIQIEIIEWIRGISGVIIFRPDISHATVQDKLSGELFT
IPD113Ab (249) PTIFKEWRIWREIQIEIIEWIRGISGVIIFRPDISHATVQDKLSGELFT
IPD113Bb (249) PTIFKEWRIWREIQIEIIEWIRGQSGVIFRPDISHATVQDKLSGELFT
IPD113Bc (249) PTIFKEWRIWREIQIEIIEWIRGISGVIIFRPDISHATVQDKLSGELFT
IPD113Db (226) PNVFKRWKIWRIQIEIIAWVIRGICGNLIRPDVSYATVEDKISGALFI
IPD113Dh (229) PNVFRRWKIWRIQIEIITWVRGICGNLIRPDVSYATVEDKISGILFI
IPD113Ei (242) PIIFRRWKIWREIQIEIIAWIIGICGNLIRPNISHATVIDKVSGIVLA
IPD113Ej (242) PIIFRRWKIWREIQIEIIAWIIGICGNLIRPNVSHATVIDKVSGIVLA
IPD113Fl (242) PSLFRKWKIWREIIEIISWVVIGIIGNLVIPDISHATVEDKLTGIIVI
IPD113Fa (242) PVIFRQWKIWREIQVQIITWTRNAIIGVINIRPISSHATVEDRISGEIFV
IPD113Gg (183) PDIFKKWKIWRIIQVEIIAWVIIPTAIIIFIIESHATVIDTITGEIII
IPD113Gh (183) PDIFKKWKIWRAIQVEIIAWVIIITAIIFFIIESHATVIDTITGEIKH
```

Fig. 2C

```
             301                                                      350
IPD113Aa (298) FRVN  Q STTIFSGV RDH TRMINEAIADMASCISPTFALH LLPDDVK
IPD113Ab (299) FRVN  Q STTIFSGV RDH TRMINEAIADMASCISPTFALH LLPDDVK
IPD113Bb (299) FRVN  Q STTIFSGV RDH TRMINEAIADMASCISPTFALHTLLPDDVK
IPD113Bc (299) FRVN  Q STTIFSGV RDH TRMINEAIADMASCISPTFALHTLLPDDVK
IPD113Db (276) FQAT    STTLF  VCEDHKTRMVNEAIADMASCLSPTFAFHKLLPDDIQ
IPD113Dh (279) FQAT    STTIFS VCEDHKTRMVNEAIADMASCLSPTFAFHKLLPDDIQ
IPD113Ei (292) FRAQ    STTIFSGLCEGHKTRM NEAVADMASCLSPTFAFHKLLPD IQ
IPD113Ej (292) FRAQ    STTIFSGLCEGHKTRM NEAVADMASCLSPTFAFHKLLPD IQ
IPD113Fl (292) F VA    STTIF  VCQDHK RMANEAVADMASCMSSTFAFR LLPDRIQ
IPD113Fa (292) FR D    STTIFL  VCEDHRTRM NEAVADMAS ISPTFAFHKLLPDDVQ
IPD113Gg (233) F V      S AIFA ICEDHKTRM NDA GDMA CISTTFVF KLLPDN K
IPD113Gh (233) F V      S AIFA ICEDHKTRM NDA GDMA CISTTFVF KLLPDN K 351                                                      400
IPD113Aa (348) T FSPYDR LFGRV RGPYSQDL   LFT      -----VK FRS P RFDQTA
IPD113Ab (349) T FSPYDK LFGRV RGPYSQDL  QLFT      -----VK FRS P RFDQTA
IPD113Bb (349) TKYSPYDK IFGRV RGPYSQDL  QLFT      -----VK FRS P RFDQTA
IPD113Bc (349) TK SPYDK AIFGRV RGPYSQDL  QLFT     -----VK FRS P RFDQTA
IPD113Db (326) TQFSPYDR  FGQVFRGPYSQDL   LWT      -----  FRS T R DQT
IPD113Dh (329) TQFSPYDR  FGQVFRGPYSQDL   LWT      -----  FRS T R DQT
IPD113Ei (342)  QFS  FDRE FGQVFRGPYSQD   LT       ---L  F T P  FD T
IPD113Ej (342)  QFS  FDRE FGQVFRGPYSQDL   LT      ---L  F T P  FD T
IPD113Fl (342)  QY  YDRELFGQVFRGPYSQD    V T      ---- R FRT P  FD TA
IPD113Fa (342)    H YDE  FG VFRGPYS DLL          ---A  FRS T R D  T
IPD113Gg (283) -NFP YDKEV I---------------------------------------
IPD113Gh (283) -NFP YDKEVFGR FKGPYS DL         VP FRT P HHD SS 401                                                      450
IPD113Aa (393) RD-RV KVIIRAGHHVDAIQF YDH  N NSTT GIMAGN SGG--- RH
IPD113Ab (394) RD-RV KVIIRAGHHVDAIQF YDH  N NSTT GIMAGN SGG--- RH
IPD113Bb (394) RD-RVLEVIIRA HHVDAIQFLYDH N  TT GLMAGN SGG--- RYQ
IPD113Bc (394) RD-RVLEVIIRA HHVDAIQFLYDH  N TT GLMAGN SGG--- RYQ
IPD113Db (371) RD-R LEVIIRAGHHVDAIQFVYDH N  TT GTVAGNAAGG--- RHQ
IPD113Dh (374) RD-R LEVIIRAGHHVDAIQFVYDH N NSTT GI AGNAAGG--- RHQ
IPD113Ei (389)  --RVLEV IRSGHHVDAI F YGH D NS T GIM GN GG--- HQ
IPD113Ej (389)  --RVLEV IRSGHHVDAI F YGH D NS T GIM GN GG--- HQ
IPD113Fl (387) D-RV ELIV TA H GTMQFVY D ---NS   GLVAGNASGG   RH
IPD113Fa (389)   V VEV IRAGHHVDAIQF YG AN- GNV GVMAGNN GG--- L RQ
IPD113Gg (293) ---------IR  N IDAMQFIYAN Q------GLLAGNAQGG--- RHD
IPD113Gh (332) NS  I KVIIR  N IDAMQFIYAN Q------GLLAGNAQGG--- RHD
```

Fig. 2D

```
                      451                                                  500
IPD113Aa   (439)   IDVKDRPIKELRMEFSHNVLASLQLHFQDG--TATQKFGNKGWASRIAT
IPD113Ab   (440)   IDVKDRPIKELRMEFSKNVLASLQLHFQDG--TATQKFGNVGWASRIAT
IPD113Bb   (440)   INVRDRPIKELRMEFSKDVLASLQLHFQDG--TATQKFGNKSWATKIAT
IPD113Bc   (440)   INVRDRPIKELRMEFSKDVLASLQLHFQDG--TATQKFGNKSWATKIAT
IPD113Db   (417)   VDVRDRPIQELRMEFSKDVLASLQLHFEDG--TSTKKFGNKGWATRILT
IPD113Dh   (420)   IDVRDRPIKEVRMEFSKDVLASLQLHFEDG--TSTRKFGNKGWATRILT
IPD113Ei   (434)   VDVRGRKIQDLRMEFSKDILAALQLHFQDG--TKTKKFGNLGWASRVLT
IPD113Ej   (434)   VDVRGRKIQDLRMEFSKDILAALQLHFQDG--TSTKKFGNLGWASRVLT
IPD113Fl   (434)   IDVKDKPIKDLRLEFKKEALASLQLKFKDG--SSTKRLGNKGKAEEKVT
IPD113Fa   (435)   FDVRHRKIKKVRMEFAKNILAAIQLKFKDG--TTTKRLGNKDWKTKVAT
IPD113Gg   (325)   VDVKGKPINKLHMKFGKGVLASVQIKYKDGTLSKSKKYGNKGWKKQKVK
IPD113Gh   (373)   VDVKGKPINKLHMKFGKGVLASVQIKYKDGTLSKSKKYGNKGWKKQKVK 501                                                  550
IPD113Aa   (487)   CTAPYKYKLSSWAFREDPGPYKTTAISVLRFDFTPEKKKK---------
IPD113Ab   (488)   CTAPYKYKLSSWAFREDPGPYKTTAISVLRFDFTPEKKKK---------
IPD113Bb   (488)   CTAPKGYKLSSWAFREDPGPNKTKAISVLRFDFTPEKKKK---------
IPD113Bc   (488)   CTAPKGYKLSSWAFREDPGPKKTKAISVLRFDFTPEDKKK---------
IPD113Db   (465)   CTAPYGYRKSSWAFREDPGPYKTTAISVLRFQFTPELDKKKKKKKKK--
IPD113Dh   (468)   CTKPYGYRKSSWAFREDPGPYKTTAISVLRFQFTPELDKKKK-------
IPD113Ei   (482)   CTAPYGYRKSSWAFRKDKGPYKTKAAISVLRFQFTPELDKKKKKK----
IPD113Ej   (482)   CTAPYGYKLSSWGFRKDKGPYKTAAISVLRFQFAPDLDKKKKKK-----
IPD113Fl   (482)   CTKVPKGYRKSSWAFRKDP------AISVLRFQFTPEKKKKKKKKKKYT
IPD113Fa   (483)   CTKPKGYKLSSWAKRQDKGPYKTAAKSVLRFQYAPKIEK----------
IPD113Gg   (375)   ANGPKKAYRVSSWSYKKDKGPKKSSGKSVIQLEYTPQIK----------
IPD113Gh   (423)   ANGPKKAYRVSSWSYKVDKGPKKSSGKSVIQLEYTPQIK----------

551
IPD113Aa   (527)   --------
IPD113Ab   (528)   --------
IPD113Bb   (528)   --------
IPD113Bc   (528)   --------
IPD113Db   (513)   --------
IPD113Dh   (510)   --------
IPD113Ei   (528)   --------
IPD113Ej   (528)   --------
IPD113Fl   (526)   KKKKKKKK
IPD113Fa   (522)   --------
IPD113Gg   (413)   --------
IPD113Gh   (461)   --------
```

Fig. 3A

```
                        1                                                  50
IPD113Aa    (1)    MDSDLIAQP DDNAASVGAPAAEKVQEDQLV-VTTPEMEDSDVDPQFEQE
IPD113Ae    (1)    MDSDLIAQPHDDNAASVGAPAAEKV EDQLV-VTTPEMEDSDVDPQFEQE
IPD113Ab    (1)    MDSDLIA PHD NAASVGAPAAEKVQEDQLV VTTPEMEDSDVDPQFEQE
IPD113Ac    (1)    MDSDLIAQP DDNAASVGAPAAEKVQEDQLV-VTTPEMEDSDVDPQFEQE
IPD113Ad    (1)    MDSDLIA PHD NAASVGAPAAEKVQEDQLV VTTPEMEDSDVDPQFEQE
IPD113Ba    (1)    MDSDLIAQPHDDNAASVGAPAAEKV       VV         QDSDVDPQFEQE
IPD113Bb    (1)    MDSDLIAQPHDDNAASVGAPAAEKV       VV         QDSDVDPQFEQE 51                                                 100
IPD113Aa    (50)   MINISALIAAGAVEGHDDVDLFAKYMQVEAHDW NRLRQAILGLTLAIPN
IPD113Ae    (50)   MINISALIAAGAVEGHDDVDLFAKYMQVEAHDW NRLRQAILGLTLAIPN
IPD113Ab    (51)   MINISALIAAGAVEGHDD DLFAKYMQV AHDWHNRLRQAILGLTLAIPN
IPD113Ac    (50)   MINISALIAAGAVEGHDD DLFAKYMQV AHDWHNRLRQAILGLTLAIPN
IPD113Ad    (51)   MINISALIAAGAVEGHDD DLFAKYMQV AHDWHNRLRQAILGLTLAIPN
IPD113Ba    (51)   M NISALIAAGAVEGHDDVDLFAKYMQVEAHDWHNRLRQAILGLTLAIPN
IPD113Bb    (51)   M NISALIAAGAVEGHDDVDLFAKYMQVEAHDWHNRLRQAILGLTLAIPN 101                                                150
IPD113Aa    (100)  PIVGLAISGFIRL WPANKVSIWEALNAEQYITNIVQQELMQFEMRTLQS
IPD113Ae    (100)  PIVGLAISGFIRL WPANKVSIWEALNAEQYITNIVQQELMQFEMRTLQS
IPD113Ab    (101)  P VGLAISGFIRLIWP NKVSIW ALNAEQYITNIVQQELMQ EMRTLQS
IPD113Ac    (100)  P VGLAISGFIRLIWP NKVSIW ALNAEQYITNIVQQELMQ EMRTLQS
IPD113Ad    (101)  P VGLAISGFIRLIWP NKVSIW ALNAEQYITNIVQQELMQ EMRTLQS
IPD113Ba    (101)  PIVGLAISGFIRLIWPANKVSIWEALNAEQYI NIVQQELMQFEMRTLQS
IPD113Bb    (101)  PIVGLAISGFIRLIWPANKVSIWEALNAEQYI NIVQQELMQFEMRTLQS 151                                                200
IPD113Aa    (150)  RIEALQTTIHRYDQAAATTEKGNFLSNWI QADGLLSSMRNSSNRIHLLL
IPD113Ae    (150)  RIEALQTTIHRYDQAAATTEKGNFLSNWISQADGLLSSMRNSSNRIHLLL
IPD113Ab    (151)  RIEALQTTI RYDQAAATTEKG FLS WISQADGLLSSMRNSSNRIHLLL
IPD113Ac    (150)  RIEALQTTI RYDQAAATTEKG FLS WISQADGLLSSMRNSSNRIHLLL
IPD113Ad    (151)  RIEALQTTI RYDQAAATTEKG FLS WISQADGLLSSMRNSSNRIHLLL
IPD113Ba    (151)   IE LQTTIHRYDQAAA PEKGNFLSNWISQADGL SSMRNSSNRIHLLL
IPD113Bb    (151)   IE LQTTIHRYDQAAA PEKGNFLSNWISQADGL SSMRNSSNRIHLLL
```

Fig. 3B

```
              201                                                      250
IPD113Aa (200) HIVTVAALHMAALHERLTFGEELYGLNDTASWQRALVEMFEEYTIKLIPT
IPD113Ae (200) HIVTVAVLHMAALHERLTFGEELYGLNDTASWKRALVEMFEEYTIKLIPT
IPD113Ab (201) HIVTVAVLHMAALHERLTFGEELYGLNDTASWKRALVEMFEEYTIKLIPT
IPD113Ac (200) HIVTVAVLHMAALHERLTFGEELYGLNDTASWKRALVEMFEEYTIKLIPT
IPD113Ad (201) HIVTVAVLHMAALHERLTFGEELYGLNDTASWKRALVEMFEEYTIKLIPT
IPD113Ba (201) HIVTVATLHMAALHERLSFGKELYGVDDTASWKRALQMFEEYTIKLIPT
IPD113Bb (201) HIVTVATLHMAALHERLSFGKELYGVDDTASWKRALQMFEEYTIKLIPT 251                                                      300
IPD113Aa (250) IFKEWRPWRERQIEINEWRQRGQSGVTIFRPDSSHATVQDKLSGELFTFR
IPD113Ae (250) IFKEWRPWRERQIEINEWRQRGQSGINHRPNSSHATVQDKLSGELFTFR
IPD113Ab (251) IFKEWRPWRERQIEINEWRQRGQSGVTIFRPDSSHATVQDKLSGELFTFR
IPD113Ac (250) IFKEWRPWRERQIEINEWRQRGQSGVTIFRPDSSHATVQDKLSGELFTFR
IPD113Ad (251) IFKEWRPWRERQIEINEWRQRGQSGVTIFRPDSSHATVQDKLSGELFTFR
IPD113Ba (251) IFKEWRPWREQIEINEWRQRGQSGVSIFRPDSSHATVQDKLSGELFTFR
IPD113Bb (251) IFKEWRPWREQIEINEWRQRGQSGVSIFRPDSSHATVQDKLSGELFTFR 301                                                      350
IPD113Aa (300) VNYQYSTTIFSGVTRDHRTRMINEAIADMASCISPTFALHMLLPDDVKTR
IPD113Ae (300) VNYQYSTTIFSGVTRDHRTRMINEAIADMASCISPTFALHMLLPDDVKTR
IPD113Ab (301) VNYQYSTTIFSGVTRDHRTRMINEAIADMASCISPTFALHMLLPDDVKTR
IPD113Ac (300) VNYQYSTTIFSGVTRDHRTRMINEAIADMASCISPTFALHMLLPDDVKTR
IPD113Ad (301) VNYQYSTTIFSGVTRDHRTRMINEAIADMASCISPTFALHMLLPDDVKTR
IPD113Ba (301) VNYQYSTTIFSGVTRDHRTRMINEAIADMASCISPTFALHLLPDDVKTK
IPD113Bb (301) VNYQYSTTIFSGVTRDHRTRMINEAIADMASCISPTFALHLLPDDVKTK
                                                         ▲

351                                                      400
IPD113Aa (350) FSPYDKELFGRVRRGPYSQDLLQQLFTSVKDFRSHPRRFDQTARDRVVKV
IPD113Ae (350) FSPYDKQLFGRVRRGPYSQDLLQQLFTNVKDFRSQPIRDQTARDRVVKV
IPD113Ab (351) FSPYDKELFGRVRRGPYSQDLLQQLFTSVKDFRSHPRRFDQTARDRVVKV
IPD113Ac (350) FSPYDKELFGRVRRGPYSQDLLQQLFTSVKDFRSHPRRFDQTARDKVMGV
IPD113Ad (351) FSPYDKELFGRVRRGPYSQDLLQQLFTSVKDFRSHPRRFDQTARDKVMGV
IPD113Ba (351) YSPYDKIFGRV---------------------------------------
IPD113Bb (351) YSPYDKIFGRVRRGPYSQDLQQLFTVKDFRSHPRRFDQTARDRVLKV
```

Fig. 3C

```
              401                                                   450
IPD113Aa (400) IIRAQHHVDAIQFWYDHVNNNSTTTGIMAGNSSGGIRHEIDVKDRPIEEL
IPD113Ae (400) IIRAQHHVDAIQFWYDHANNNSTTTGIMAGNSSGGIRHEIDVKDRPIEEL
IPD113Ab (401) IIRAQHHVDAIQFWYDHVNNNSTTTGIMAGNSSGGIRHEIDVKDRPIEEL
IPD113Ac (400) IIRAQHHVDAIQFWYTRANNNSISSGIMAGNSSGGIRYDINVRDRPIEEL
IPD113Ad (401) IIRAQHHVDAIQFWYTRANNNSISSGIMAGNSSGGIRYDINVRDRPIEEL
IPD113Ba (363) IIRAQHHVDAIQFYYDHANENTTNGLMAGNSSGGIRYQINVRDRPIEEL
IPD113Bb (401) IIRAQHHVDAIQFYYDHANENTTNGLMAGNSSGGIRYQINVRDRPIEEL 451                                         500
IPD113Aa (450) RMEFSHNVLASLQLHFQDGTATQKFGNVNGWASRIATCTAPYSYKLSSWA
IPD113Ae (450) RMEFSHDVLASLQLHFQDGTATQKFGNVNGWASRIATCTAPYSYKLSSWA
IPD113Ab (451) RMEFSHNVLASLQLHFQDGTATQKFGNVNGWASRIATCTAPYSYKLSSWA
IPD113Ac (450) RMEFSRDVLASLQLHFQDGTATQKFGNVNGWATRIATCTAPYSYKLSSWA
IPD113Ad (451) RMEFSRDVLASLQLHFQDGTATQKFGNVNGWATRIATCTAPYSYKLSSWA
IPD113Ba (413) RMEFSRDVLASLQLHFQDGTATQKFGNVNSWATTIATCTAPFGYKLSSWA
IPD113Bb (451) RMEFSRDVLASLQLHFQDGTATQKFGNVNSWATTIATCTAPFGYKLSSWA
                                                        ▲
              501              527
IPD113Aa (500) FREDPGPNNTTAISVLRFDFTPEDPSS
IPD113Ae (500) FREDPGPNGTTAISVLRFDFTPEDPSS
IPD113Ab (501) FREDPGPNNTTAISVLRFDFTPEDPSS
IPD113Ac (500) FREDPGPNGTTAISVLRFDFTPEDPSS
IPD113Ad (501) FREDPGPNGTTAISVLRFDFTPEDPSS
IPD113Ba (463) FREDPGPNGTTAISVLRFDFTPEDPST
IPD113Bb (501) FREDPGPNGTTAISVLRFDFTPEDPST
```

```
                        51                                                    100
IPD113Da   (37)  --------- MAEEDPIFAQLAQKMAAAAEK---EEAP----VDLLAQYM
IPD113Dai  (25)  --------- MAEEDPIFAQLAQKMAAAAEK---EEAP----VDLLAQYM
IPD113Dal   (1)  ----------MAEEDPIFAQLAQKMAAAAEK---EEAP----VDLLAQYM
IPD113Daj  (38)  --------- MAEEDPIFAQLAQKMAAAAEK---EEAP----VDLLAQYM
IPD113Dc   (26)  --------- MAEEDPIFAQLAQKMAAAAEK---EEAP----VDLLAQYM
IPD113Dae  (24)  ----------MAEEDPIFSQLAQKMAAAAEK--- EVP----VDLLAKYM
IPD113Dah  (24)  ----------MAEEDPIFSQLAQKMAAAAEK--- EVP----VDLLAKYM
IPD113Daf  (24)  ----------MVEEDPIFSQLAQKMAAAAEK--- EVP----VDLLAKYM
IPD113Dag  (24)  ----------MAEEDPIFSQLAQKMAAAAEK--- EVP----VDLLAKYM
IPD113Dan  (21)  --------- EEDPIFSQLAQKMVAAAE ---EVP---VVDLLAQYM
IPD113Ead  (21)  --------- EEDPIFSQLAQKMVAAAE ---EVP---VVDLLAQY
IPD113Eh   (20)  --------- EEDPIFSQLAQKMVAAAE ---EVP---VVDLLAQY
IPD113Dao  (21)  --------- EEDPIFSQLAQKMVAAAE ---E P---VVDLLAQYM
IPD113Es   (23)  --------- EEDPIFSQLAQKMVAAAE ---E VP----VDLLAQYM
IPD113Di   (24)  -------- VEEDPIFSQLAQKMVAAA ---E  VP-VDLLAQYM
IPD113Dk   (24)  -------- VEEDPIFSQLAQKMVAAA ---E  VP-VDLLAQYM
IPD113Dj   (24)  -------- VEEDPIFSQLAQKMVAAA ---E  P-VDLLAQYM
IPD113Dl   (23)  -------- MEEDPVFSQLAQKMVAAA   QE P----VDLLA YM
IPD113Ds   (50)  -------  EEDPIFA LAQ MVAAA   QE P----VDLLARYM
IPD113Du   (46)  -------  EEDPIFA LAQ MVAAA   QE P----VDLLARYM
IPD113Dp   (25)  V APA  D  AEEDPIFAQLAQEM AAK---  D --PVVDL KYM
IPD113Eaa  (24)  -- AVVDM AEEDPIFAQLAQEM VAAK---  ----- AVDLT FM
IPD113Ez   (24)  -- A VDM AEEDPIFAQLAQEM AAAK---  ----- AVDLT FM
IPD113Eac  (24)  -- AV DM AEEDPIFA LAQ M VAA K---  ----- AVDLT FM
IPD113Ey   (24)  -- AV DM AEEDPIFA LAQ M VAA K---  ----- AVDLT FM
IPD113Eab  (24)  -- A    AEEDPIFAKLAQ M VAA K---  ----- AVDLT YM
IPD113Eu   (27)      E M ANEDPIFAQLAQEM VAAEK--- E --PVVDLI KYM
IPD113Ex   (27)      E M ANEDPIFAQLAQEM VAAEK--- E --PVVDLI KYM
IPD113Ev   (27)      E M ANEDPIFAQLAQEM VAAEK--- E --PVVDLI KYM
IPD113Ew   (27)      E M ANEDPIFAQLAQEM VAAEK--- E --PVVDLI KYM
IPD113De   (35)  --------  MVEEDPIFAQLA KMAAAAEK--- EAP----VDLLAQYM
IPD113Df   (35)  --------  MVEEDPIFAQLA KMAAAAEK--- EAP----VDLLAQYM
IPD113Dg   (32)  --------  MVEEDPIFAQLA KMAAAAEK--- EAP----VDLLAQYM
IPD113Dm   (35)  --------  MVEEDPIFAQLAQKMAAAAEK--- EAP----VDLLAQYM
IPD113Dn   (32)  --------  MVEEDPIFAQLAQKMAAAAEK--- EAP----VDLLAQYM
IPD113Dam   (1)  ----------MAEEDPIFAQLAQKMAAAAEK---EE P----VDLLAQYM
IPD113Db   (22)  --------- MAEEDPIFTQLAQKMAAAAEK---EE P----VDLLAQYM
IPD113Dap   (1)  ----------MAEEDPIFTQLAQKMAAAA K---EE VP----VDLLAQYM
IPD113Ee   (38)  --------- MAEEDPIFTQLA KMA AAEK---EE P----VDLLAQYM
IPD113Ef   (38)  --------- MAEEDPIFTQLA KMA AAEK---EE P----VDLLAQYM
IPD113Eg   (38)  --------- MAEEDPIFTQLA KMA AAEK---EE P----VDLLAQYM
IPD113Daq   (1)  ----------MAEEDPIFTQLAQKMAAAA K---EE P----VDLLAQYM
IPD113Do   (35)  --------- MAEEDPIFAQLAQKMAAAAE ---EE P----VDLLAQYM
IPD113Dd   (39)  ---------  AEEDPIFTQLAQKMAAAAEK---EEAP----VDLLAQYM
IPD113Dak   (1)  ----------MAEEDPIFAQLAQKMAAAAEK---EEAP----VDLLAQYM
IPD113Dh   (25)  --------- MAEEDPIFAQLAQKMAAAAEK---EEAP----VDLLAQYM
```

Fig. 4C

```
                    101                                                150
IPD113Da    (72)    QVEAHDWHNRIRGAILGLISAVPKVGAAISRLIGLFWPSNKVDIWEALNA
IPD113Dai   (60)    QVEAHDWHNRIRGAILGLISAVPKVGAAISRLIGLFWPSNKVDIWEALNA
IPD113Dal   (34)    QVEAHDWHNRIRGAILGLISAVPKVGAAISRLIGLFWPSNKVDIWEALNA
IPD113Daj   (73)    QVEAHDWHNRIRGAILGLISAVPKVGAAISRLIGLFWPSNKVDIWEALNA
IPD113Dc    (61)    QVEAHDWHNRIRGAILGLISAVPKVGAAISRLIGLFWPSNKVDIWEALNA
IPD113Dae   (57)    QVEAHDWHNRIRGAILGLISAVPKVGAAISRLIGLFWPTNKVDIWEAINA
IPD113Dah   (57)    QVEAHDWHNRIRGAILGLISAVPKVGAAISRLIGLFWPTNKVDIWEAINA
IPD113Daf   (57)    QVEAHDWHNRIRGAILGLISAVPKVGAAISRLIGLFWPTNKVDIWEAINA
IPD113Dag   (57)    QVEAHDWHNRIRGAILGLISAVPKVGAAISRLIGLFWPTNKVDIWEAINA
IPD113Dan   (55)    QVEAHDWHNRIRGAVLGLISAVPKVGAAISRLIGLFWPANRVDIWEALNA
IPD113Ead   (55)    HVEAHDWHNRIRGAVLALIALVPKVGAAISRLVGLFWPANRVNIWEALNA
IPD113Eh    (54)    HVEAHDWHNRIRGAVLALIALVPKVGAAISRLVGLFWPANRVNIWEALNA
IPD113Dao   (55)    QVEAHDWHNRIRGAVLALIALVPKVGAAISRLIGLFWPANRVDIWWALNA
IPD113Es    (56)    QVEAHDWHNRIRGAVLGLISAVPKVGAAISRLIGLFWPANRVDIWEALNA
IPD113Di    (61)    QVEAHDWHNRIRGAVLGLISAVPKVGAAISRLIGLFWPSNKVDIWEALNA
IPD113Dk    (61)    QVEAHDWHNRIRGAVLGLISAVPKVGAAISRLIGLFWPSNKVDIWEALNA
IPD113Dj    (61)    QVEAHDWHNRIRGAVLGLISAVPKVGAAISRLIGLFWPSNKVDIWEALNA
IPD113Dl    (61)    QVEAHDWHNRIRGAVLGLLSAVPKVGAAISRLIGLFWPANRVDIWEAINA
IPD113Ds    (88)    QVEAHDWHNRIRGAVLGLISVVPKVGAAISRLIGLFWPANKVDIWEAIKA
IPD113Du    (84)    QVEAHDWHNRIRGAVLGLISVVPKVGAAISRLIGLFWPANKVDIWEAIKA
IPD113Dp    (70)    QVQAHDWHNRIRGAILGLISLVPKVGAAVSRLIGLFWPANRVDIWEALLL
IPD113Eaa   (64)    QVQAHDWHNRVRGAILGLLSLVPKVGGAISRLIGLFWPANKVDIWEALLL
IPD113Ez    (64)    QVQAHDWHNRVRGAILGLLSLVPKVGGAISRLIGLFWPANKVDIWEALLL
IPD113Eac   (64)    QVQAHDWHNRVRGAILGLLSLVPKVGGAISRLIGLFWPANKVDIWEALLL
IPD113Ey    (64)    QVQAHDWHNRVRGAILGLLSLVPKVGGAISRLIGLFWPANKVDIWEALLL
IPD113Eab   (64)    QVEAHDWHNRVRGAILGLISLVPKVGGAISRLIGLFWPANRVDIWEALLL
IPD113Eu    (72)    QVEAHDWHNRVRGAILGLISLVPKVGSAISRLIGLFWPANRVHIWEALLL
IPD113Ex    (72)    QVEAHDWHNRVRGAILGLISLVPKVGSAISRLIGLFWPANRVHIWEALLL
IPD113Ev    (72)    QVEAHDWHNRVRGAILGLISLVPKVGSAISRLIGLFWPANRVHIWEALLL
IPD113Ew    (72)    QVEAHDWHNRVRGAILGLISLVPKVGSAISRLIGLFWPANRVHIWEALLL
IPD113De    (70)    QVEAHDWHNRIRGAILGLISLVPKVGAAVSRLIGLFWPANKVDIWEALLA
IPD113Df    (70)    QVEAHDWHNRIRGAILGLISLVPKVGAAVSRLIGLFWPANKVDIWEALLA
IPD113Dg    (67)    QVEAHDWHNRIRGAILGLISLVPKVGAAVSRLIGLFWPANKVDIWEALLA
IPD113Dm    (70)    QVEAHDWHNRIRGAILGLISAVPKVGAAISRLIGLFWPANRVDIWEALLA
IPD113Dn    (67)    QVEAHDWHNRIRGAILGLISAVPKVGAAISRLIGLFWPANRVDIWEALLA
IPD113Dam   (34)    QVEAHDWHNRVRGAILGLISAVPKVGAAISRLIGLFWPANKVDIWEALLA
IPD113Db    (57)    QVEAHDWHNRVRGAILGLISAVPKVGAAISRLIGLFWPANKVDIWEALLA
IPD113Dap   (34)    QVEAHDWHNRVRGAILGLISAVPKVGAAISRLIGLFWPANKVDIWEALLL
IPD113Ee    (73)    QVEAHDWHNRVRGAILGLISAVPKVGAAISRLIGLFWPANKVDIWEALLL
IPD113Ef    (73)    QVEAHDWHNRVRGAILGLISAVPKVGAAISRLIGLFWPANKVDIWEALLL
IPD113Eg    (73)    QVEAHDWHNRVRGAILGLISAVPKVGAAISRLIGLFWPANKVDIWEALLL
IPD113Daq   (34)    QVEAHDWHNRVRGAILGLISAVPKVGAAISRLIGLFWPANKVDIWEALLL
IPD113Do    (70)    QVEAHDWHNRVRGAILGLISAVPKVGAAISRLIGLFWPANKVDIWEALLL
IPD113Dd    (74)    QVEAHDWHNRIRGAILGLISAVPKVGAAISRLIGLFWPSNKVDIWEALNL
IPD113Dak   (34)    QVEAHDWHNRIRGAILGLISAVPKVGAAISRLIGLFWPSNKVDIWEALNA
IPD113Dh    (60)    QVEAHDWHNRIRGAILGLISAVPKVGAAISRLIGLFWPSNKVDIWEALNA
```

Fig. 4D

```
                     151                                                    200
  IPD113Da   (122)   EEYIRNIVQQELFEFEMQLLQNDIQALEATVGRYDTAALTE-KGNFLSIW
  IPD113Dai  (110)   EEYIRNIVQQELFEFEMQLLQNDIQALETTVGRYDTAALTE-KGNFLSIW
  IPD113Dal   (84)   EEYIRNIVQQELFEFEMQLLQNDIQALETTVGRYDTAALTE-KGNFLSIW
  IPD113Daj  (123)   EEYIRNIVQQELFEFEMQLLQNDIQALETTVGRYDTAALTE-KGNFLSIW
  IPD113Dc   (111)   EEYIRNIVQQELFEFEMQLLQNDIQALETTVGRYDTAALTE-KGNFLSIW
  IPD113Dae  (107)   EEYIRNIVQRELFEFEMQLLNDIEALETTVARYDAALNAKGNFLSIW
  IPD113Dah  (107)   EEYIRNIVQRELFEFEMQLLNDIEALETTVARYDAALNAKGNFLSIW
  IPD113Daf  (107)   EEYIRNIVQRELFEFEMQLLNDIEALETTVARYDAALNAKGNFLSIW
  IPD113Dag  (107)   EEYIRNIVQRELFEFEMQLLNDIEALETTVARYDAALNAKGNFLSIW
  IPD113Dan  (105)   EEYIRNIVQQELFEFEMQLLNDIEALETTVARYDAALN-EKGNFLSIW
  IPD113Ead  (105)   EEYIRNIVQQEIFEFEMQLLSDIQALETTVARYDAAANKGNFLSIW
  IPD113Eh   (104)   EEYIRNIVQQEIFEFEMQLLSDIQALETTVARYDAAANKGNFLSIW
  IPD113Dao  (105)   EEYIRNIVQELFEFEMQLLNDIEALETTVARYDAALT-EKGNFLSIW
  IPD113Es   (106)   EEYIRNIVQQELFEFEMQLLNDIEALETTVARYDAALT-EKGNFLSIW
  IPD113Di   (111)   EEYIRNIVQQELFEFEMQLLNDIEALETTVGRYDTAALT-EKGNFLSIW
  IPD113Dk   (111)   EEYIRNIVQQELFEFEMQLLNDIEALETTVGRYDTAALT-KGNFLSIW
  IPD113Dj   (111)   EEYIRNIVQQELFEFEMQLLNDIEALETTVGRYDTAALT-KGNFLSIW
  IPD113Dl   (111)   EEYIRNIVQQEIFEFELQLLSDIEALETTIGHYDTAALTE-KGFLSIW
  IPD113Ds   (138)   EEYIRNIVQQEIFEFEMQLLNDIEALETTVARYTAVLNE-KGNFLSIW
  IPD113Du   (134)   EEYIRNIVQQEIFEFEMQLLNDIEALETTVARYTAVLNE-KGNFLSIW
  IPD113Dp   (120)   EQYIRNIVQQEIFDFEMQLLSDIEALETTVARYDAALNE-KGNFLSIW
  IPD113Eaa  (114)   EEYVRNIVQQEIFDFEMRLLQADIEALETTITRYDAALPE-KGNFLSIW
  IPD113Ez   (114)   EEYVRNIVQQEIFDFEMRLLQADIEALETTITRYDAALPE-KGNFLSIW
  IPD113Eac  (114)   EEYVRNIVQQEIFDFEMRLLQSDIEALETTITRYDAALPE-KGNFLSIW
  IPD113Ey   (114)   EEYVRNIVQQEIFDFEMRLLQSDIEALETTIARYDAALPE-KGNFLSIW
  IPD113Eab  (114)   EEYVRNIVQQEIFDFEMRLLQSDIEALETTIARYDAALPE-KGNFLSIW
  IPD113Eu   (122)   EEYVRNIVQQEIFDFEMQLLSDIEALESTVARYDAALPE-KGNFLSIW
  IPD113Ex   (122)   EEYVRNIVQQEIFDFEMQLLSDIEALESTVARYDAALPE-KGNFLSIW
  IPD113Ev   (122)   EEYVRNIVQQEIFDFEMQLLSDIEALESTVARYDAALGE-KGNFLSIW
  IPD113Ew   (122)   EEYVRNIVQQEIFDFEMQLLSDIEALESTVARYDAALGE-KGNFLSIW
  IPD113De   (120)   EEYIRNIVQQELFEFEMRLLQDDIEALEMTVARYDAALTE-KGNFLSIW
  IPD113Df   (120)   EEYIRNIVQQELFEFEMRLLQDDIEALEMTVARYDAALTE-KGNFLSIW
  IPD113Dg   (117)   EEYIRNIVQQELFEFEMRLLQDDIEALEMTVARYDAALTE-KGNFLSIW
  IPD113Dm   (120)   EEYIRNIVQQELFEFEMRLLQNDIEALEMTVGRYDTAALTE-KGNFLSIW
  IPD113Dn   (117)   EEYIRNIVQQELFEFEMRLLQNDIEALEMTVGRYDTAALTE-KGNFLSIW
  IPD113Dam   (84)   EEYIRNIVQQELFEFEMRLLNDIQALETTVGRYDTAALTE-KGNFLSIW
  IPD113Db   (107)   EEYIRNIVQQELFEFEMRLLNDIQALETTVGRYDTAALTE-KGNFLSIW
  IPD113Dap   (84)   EEYIRNIVQQELFEFELRLLNDIQALETTVGRYDTAALTE-KGNFLSIW
  IPD113Ee   (123)   EEYIRNIVQQELFEFELRLLNDIQALETTVGRYDAALTE-KGNFLSIW
  IPD113Ef   (123)   EEYIRNIVQQELFEFELRLLNDIQALETTVGRYDAALTE-KGNFLSIW
  IPD113Eg   (123)   EEYIRNIVQQELFEFELRLLNDIQALETTVGRYDAALTE-KGNFLSIW
  IPD113Daq   (84)   EEYIRNIVQQELFEFELRLLNDIQALETTVGRYDTAALTE-KGNFLSIW
  IPD113Do   (120)   EEYINNIVQQELFEFELRLLNDIQALETTVGRYDTAAKGNFLSIW
  IPD113Dd   (124)   EEYIRNIVQQELFEFELQLLQNDIQALEATVGRYDAALTE-KGNFLSIW
  IPD113Dak   (84)   EEYIRNIVQQELFEFEMQLLQNDIQALETTVGRYDTAALTE-KGNFLSIW
  IPD113Dh   (110)   EEYIRNIVQQELFEFEMQLLQNDIQALETTVGRYDTAALTE-KGNFLSIW
```

Fig. 4E

```
                        201                                                250
   IPD113Da   (171)   ISQADALYIRMRNSTNNIHLLLHMVTVSTLHLAALHERLTFGEELYGTNN
  IPD113Dai   (159)   ISQADALYIRMRNSTNNIHLLLHMVTVSTLHLAALHERLTFGEELYGTNN
  IPD113Dal   (133)   ISQADALYIRMRNSTNNIHLLLHMVTVSTLHLAALHERLTFGEELYGTNN
  IPD113Daj   (172)   ISQADALYIRMRNSTNNIHLLLHMVTVSTLHLAALHERLTFGEELYGTNN
   IPD113Dc   (160)   ISQADALYIRMRNSTNNIHLLLHMVTVSTLHLAALHERLTFGEELYGTNN
  IPD113Dae   (157)   ISQADALFIRMRNSTNNIHLLLHMVTVSTLHLAALHERLTFGEELYGTNN
  IPD113Dah   (157)   ISQADALFIRMRNSTNNIHLLLHMVTVSTLHLAALHERLTFGEELYGTNN
  IPD113Daf   (157)   ISQADALFIRMRNSTNNIHLLLHMVTVSTLHLAALHERLTFGEELYGTNN
  IPD113Dag   (157)   ISQADALFIRMRNSTNNIHLLLHMVTVSTLHLAALHERLTFGEELYGTNN
  IPD113Dan   (154)   ISQADALYIRMRNSTNNIHLLLHMVTVSTLHLAALHERLTFGEELYGTNN
  IPD113Ead   (155)   ISQADALYFRMRNSANNIHLLLHMVTVSTLHLAALHERMTFGQELYGTNN
   IPD113Eh   (154)   ISQADALYFRMRNSANNIHLLLHMVTVSTLHLAALHERMTFGQELYGTNN
  IPD113Dao   (154)   ISQADALFIRMRNSANNIHLLLHMVTVSTLHLAALHERLTFGEELYGTNN
   IPD113Es   (155)   ISQADALYIRMRNSTNNIHLLLHMVTVSTLHLAALHERLTFGEELYGTNN
   IPD113Di   (160)   ITQADALYIRMRNSTNNIHLLLHMVTVSTLHLAALHERLTFGEELYGTNN
   IPD113Dk   (160)   ITQADALYIRMRNSTNNIHLLLHMVTVSTLHLAALHERLTFGEELYGTNN
   IPD113Dj   (160)   ITQADALYIRMRNSTNNIHLLLHMVTVSTLHLAALHERLTFGEELYGTNN
   IPD113Dl   (160)   ITQASALHIRMRNSAQNIHLLLHIVTVSTLHIAALHERLFFGQELYGSNN
   IPD113Ds   (187)   ISQADALFIRMRNSPNRIHLLLHIVTVSTLHVAALHERMTFGEELYGSNN
   IPD113Du   (183)   ISQADALFIRMRNSPNRIHLLLHIVTVSTLHVAALHERMTFGEELYGSNN
   IPD113Dp   (169)   ISQADALYFRMRNSTNNIHLLLHIVTVSTLHLAALHERLTFGEELYGTNN
  IPD113Eaa   (163)   ISQADALYFRMRNSTNNIHLLLHIVTVSTLHLAALHERLTFGEELYGTNN
   IPD113Ez   (163)   ISQADALYFRMRNSTNNIHLLLHIVTVSTLHLAALHERLTFGEELYGTNN
  IPD113Eac   (163)   ISQADALYFRMRNSTNNIHLLLHIVTVSTLHLAALSERLTFGEELYGTNN
   IPD113Ey   (163)   ISQADALYFRMRNSTNNIHLLLHIVTVSTLHLAALHERLTFGEELYGTNN
  IPD113Eab   (163)   ISQADALYFRMRNSTNNIHLLLHIVTVSTLHLAALHERLTFGEELYGTNN
   IPD113Eu   (171)   ISQADALYFRLRNSTNNMHLLLHIVTVSTLHMAALHERLFFGEELYGTNN
   IPD113Ex   (171)   ISQADALYFRLRNSTNNMHLLLHIVTVSTLHMAALHERLFFGEELYGTNN
   IPD113Ev   (171)   ISQADALYFRLRNSSNNMHLLLHIVTVSTLHMAALHERLFFGEELYGTNN
   IPD113Ew   (171)   ISQADALYFRLRNSSNNMHLLLHIVTVSTLHMAALHERLFFGEELYGTNN
   IPD113De   (169)   ISQADALYIRMRNSTNNIHLLLHMVTVSTLHMAALHERLTFGEELYGTNN
   IPD113Df   (169)   ISQADALYIRMRNSTNNIHLLLHMVTVSTLHMAALHERLTFGEELYGTNN
   IPD113Dg   (166)   ISQADALYIRMRNSTNNIHLLLHMVTVSTLHMAALHERLTFGEELYGTNN
   IPD113Dm   (169)   ISQADALYIRMRNSTNNIHLLLHMVTVSTLHMAALHERLTFGEELYGSNN
   IPD113Dn   (166)   ISQADALYIRMRNSTNNIHLLLHMVTVSTLHMAALHERLTFGEELYGSNN
  IPD113Dam   (133)   ISQADALYIRMRNSTNNIHLLLHMVTVSTLHLAALHERLTFGEELYGTNN
   IPD113Db   (156)   ISQADALYIRMRNSTNNIHLLLHMVTVSTLHLAALHERLTFGEELYGTNN
  IPD113Dap   (133)   ISQADALYIRMRNSTNNIHLLLHMVTVSTLHLAALHERLTFGEELYGTNN
   IPD113Ee   (172)   ISQADALYIRMRNSTNNIHLLLHMVTVSTLHLAALHERLTFGEELYGTNN
   IPD113Ef   (172)   ISQADALYIRMRNSTNNIHLLLHMVTVSTLHLAALHERLTFGEELYGTNN
   IPD113Eg   (172)   ISQADALYIRMRNSTNNIHLLLHMVTVSTLHLAALHERLTFGEELYGTNN
  IPD113Daq   (133)   ISQADALYIRMRNSTNNIHLLLHMVTVSTLHLAALHERLTFGEELYGTNN
   IPD113Do   (170)   ISQADALYIRMRNSTNNIQLLLHMVTVSTLHLAALHERLTFGEELYGSNN
   IPD113Dd   (173)   ISQADALYIRMRNSANNIHLLLHMVTVSTLHLAALHERLTFGEELYGSNN
  IPD113Dak   (133)   ISQADALYIRMRNSTNNIHLLLHMVTVSTLHLAALHERLTFGEELYGTNN
   IPD113Dh   (159)   ISQADALYIRMRNSTNNIHLLLHMVTVSTLHLAALHERLTFGEELYGTNN
```

Fig. 4F

```
                    251                                              300
IPD113Da   (221) SANWTQDLVDKFERYTTDLIPTVFRRWKEWRPTQIEITTWVRRGSCGNLT
IPD113Dai  (209) AANWTQDLVDKFERTTTDLIPTVFRRWKEWRPTQIEITTWVRRGSCGNLT
IPD113Dal  (183) AANWTQDLVDKFERTTTDLIPTVFRRWKEWRPTQIEITTWVRRGSCGNLT
IPD113Daj  (222) AANWTQDLVDKFERYTTDLIPNVFRRWKEWRPTQIEITTWVRRGSCGNLT
IPD113Dc   (210) AANWTQDLVDKFERYTTDLIPNVFRRWKEWRPTQIEITTWVRRGSCGNLT
IPD113Dae  (207) SANWTQDLVDKFAAYTTNLIPNVFKRWKDWRPTQIEITASRRQNCGNLT
IPD113Dah  (207) SANWTQDLVDKFAAYTTNLIPNVFKRWKDWRPTQIEITASRRQNCGNLT
IPD113Daf  (207) SANWTQDLVDKFAAYTTNLIPNVFKRWKDWRPTQIEITASRRQNCGNLT
IPD113Dag  (207) SANWTQDLVDKFAAYTTNLIPNVFKRWKDWRPTQIEITASRRQNCGNLT
IPD113Dan  (204) SANWTQDLVDKFELYTTDLIPSVFKRWKDWRPTQIEITAWTRRGTCSNVT
IPD113Ead  (205) SANWTQDLVDKFALYTTDLIPSVFKRWKDWRPTQIEITAWTRGSCSNVT
IPD113Eh   (204) SANWTQDLVDKFALYTTDLIPSVFKRWKDWRPTQIEITAWTRGSCSNVT
IPD113Dao  (204) SANWTRDLVDKFELYTTDLFPSVFKRWKDWRPTQIEITAWTRRGCGNLT
IPD113Es   (205) SANWTQDLVDKFELYTTDLIPSVFKRWKDWRPAQIEITAWVRRGSCGIVT
IPD113Di   (210) SANWTQDLVDKFELYTTDLIPSVFKRWKDWRPTQIEITAWVQRGSCGNLT
IPD113Dk   (210) SANWTQDLVDKFELYTTDLIPSVFKRWKDWRPTQIEITAWVQRGSCGNLT
IPD113Dj   (210) SANWTQDLVDKFELYTTDLIPSVFKRWKDWRPTQIEITAWVQRGSCGNLT
IPD113Dl   (210) TAGWTRDLVNAFELYTTDLIPNVFKRWKEWRENQIEIAAWVVRGSCGNLT
IPD113Ds   (237) TANWTQDLVEFERYTTDLIPNVFKSWKEWRTQIEITAWVRRGTCGNLT
IPD113Du   (233) TANWTQDLVEFERYTTDLIPNVFKSWKEWRTQIEITAWVRRGTCGNLT
IPD113Dp   (219) AANWTQDLVMFRLYTVDLIPSIFKRWKEWRAQIEIAWVRGSCGNLT
IPD113Eaa  (213) AANWTQDLVMFRLYTVELIPSVFKRWKEWRAQIEIAWVRGSCGVLQ
IPD113Ez   (213) AANWTQDLVMFRLYTVELIPSVFKRWKEWRAQIEIAWVRGSCGVLQ
IPD113Eac  (213) AANWTQDLVMFRLYTVELIPSVFKRWKEWRAQIEIAWVRGSCGVLQ
IPD113Ey   (213) AANWTQDLVMFRLYTVELIPSVFKRWKEWRAQIEIAWVRGSCGVLQ
IPD113Eab  (213) AANWTQDLVMFRLYTVELIPSVFKRWKEWRAQIEIAWVIRGGCGVVM
IPD113Eu   (221) AANWTQDLVKFRLYTDLIPSIFKRWKEWRAQIEIAWVRGSCGNLT
IPD113Ex   (221) AANWTQDLVKFRLYTDLIPSIFKRWKEWRAQIEIAWVRGSCGNLT
IPD113Ev   (221) AANWTQDLVKFRLYTVDLIPSIFKRWKEWRAQIEINAWVRGSCGNLT
IPD113Ew   (221) AANWTQDLVKFRLYTVDLIPSIFKRWKEWRAQIEINAWVRGSCGNLT
IPD113De   (219) SANWTQDLVDKFERYTADLIPSVFKRWKEWRPTQIEIAWIRGSCGNLT
IPD113Df   (219) SANWTQDLVDKFERYTADLIPSVFKRWKEWRPTQIEIAWIRGSCGNLT
IPD113Dg   (216) SANWTQDLVDKFERYTADLIPSVFKRWKEWRPTQIEIAWIRGSCGNLT
IPD113Dm   (219) SANWTRDLVDKFERYTTDLIPSVFKRWKEWRPTQIEIAWIHRGSCGNLT
IPD113Dn   (216) SANWTRDLVDKFERYTTDLIPSVFKRWKEWRPTQIEIAWIHRGSCGNLT
IPD113Dam  (183) STNWTRDLVDKFEYYTSDLIPNVFKRWKEWRPTQIEISAWVRRGSCGNLT
IPD113Db   (206) STNWTRDLVDKFEYYTSDLIPNVFKRWKEWRPTQIEISAWVRRGSCGNLT
IPD113Dap  (183) SANWTQDLVDKFERYTTDLIPNVFKRWKEWRPTQIEIAWVRRGSCGNLT
IPD113Ee   (222) SVNWTQDLVEKFERYTADLIPNVFKRWKEWRPTQIEIAWVRRGSCGNLT
IPD113Ef   (222) SVNWTQDLVEKFERYTADLIPNVFKRWKEWRPTQIEIAWVRRGSCGNLT
IPD113Eg   (222) SVNWTQDLVEKFERYTADLIPNVFKRWKEWRPTQIEIAWVRRGSCGNLT
IPD113Daq  (183) SANWTQDLVDKFERYTTDLIPNVFKRWKEWRPTQIEIAWVRRGSCGNLT
IPD113Do   (220) SANWTQDLVDKFERYTADLIPNVFKRWKEWRPTQIEIAWVRRGSCGVVT
IPD113Dd   (223) SANWTRDLVDKFERYTTDLIPNVFKRWKEWRPTQIITTWVRRGSCGNLT
IPD113Dak  (183) AANWTQDLVDKFERYTTDLIPNVFRRWKEWRPTQIEITTWVRRGSCGNLT
IPD113Dh   (209) AANWTQDLVDKFERYTTDLIPNVFRRWKEWRPTQIEITTWVRRGSCGNLT
                                                                     ▲
```

Fig. 4G

```
                   301                                                    350
IPD113Da   (271)  -CRPDVSHATVEDKISGALFSFQATNRNSTTIFSEVCEDHKTRMVNEAIA
IPD113Dai  (259)  -CRPDVSYATVEDKISGALFSFQATNRNSTTIFSEVCEDHKTRMVNEAIA
IPD113Dal  (233)  -CRPDVSYATVEDKISGALFSFQATNRNSTTIFSEVCEDHKTRMVNEAIA
IPD113Daj  (272)  -CRPDVSYATVEDKISGALFSFQATNRNSTTIFSEVCEDHKTRMVNEAIA
IPD113Dc   (260)  -CRPDVSYATVEDKISGALFSFQATNRNSTTIFSEVCEDHKTRMVNEAIA
IPD113Dae  (257)  -CRPAMSFAAVEDRMSGAIFSFQATNIQSTTIFSGVCQDHKTRMTNEAIA
IPD113Dah  (257)  -CRPAMSFAAVEDRMSGAIFSFQATNIQSTTIFSGVCQDHKTRMTNEAIA
IPD113Daf  (257)  -CRPAMSFAAVEDRMSGAIFSFQATNIQSTTIFSGVCQDHKTRMTNEAIA
IPD113Dag  (257)  -CRPAMSFAAVEDRMSGAIFSFQATNIQSTTIFSGVCQDHKTRMTNEAIA
IPD113Dan  (254)  GCNPNMSYATVEDKVSGAIFTFQANNQSTTIFSAVCQDHKTRMVNEAIA
IPD113Ead  (255)  GCNPNMSYAIVEDKVSGAIFTFQANNQLSTTIFSGICQDHKTRMVNEAIA
IPD113Eh   (254)  GCNPNMSYAIVEDKVSGAIFTFQANNQSTTIFSGICQDHKTRMVNEAIA
IPD113Dao  (254)  -CRPNVSYAIVEDKVSGAIFSFQATNQSTTIFSGICQDHKTRMVNEAIA
IPD113Es   (255)  -CRPNVSYARVEDKVSGRRTTFQASNVNSTTVFSGVCEDHKTRMMNEAIA
IPD113Di   (260)  -CRPNVSYARVEDKISGAIFSFQATNRNSTTIFSGICEDHKTRMVNEAIA
IPD113Dk   (260)  -CRPNVSYARVEDKISGAIFSFQATNRNSTTIFSGICEDHKTRMVNEAIA
IPD113Dj   (260)  -CRPNVSYARVEDKISGAIFSFQATNRNSTTIFSGICEDHKTRMVNEAIA
IPD113Dl   (260)  -CRPNISHATVEDKVSGMFSFQATNRNSTTIFSGICEDHKIRMINEAIA
IPD113Ds   (287)  -CRPDVSFAQVEDKVSGAIFSFQATNRNSTTIFSGVCQDHKIRMTNEAIA
IPD113Du   (283)  -CRPDVSFAQVEDKVSGAIFSFQATNRNSTTIFIGVCQDHKIRMTNEAIA
IPD113Dp   (269)  -CRPNVSHATVEDKISGARVTFQATNQNSTTIFSAICEDHKTRMVNEAVA
IPD113Eaa  (263)  -CRPDVSHATVEDKISGAIFSFQATNRNSTTIFSAICEDHKTRMVNEAVA
IPD113Ez   (263)  -CRPDVSHATVEDKISGAIFSFQATNRNSTTIFSAICEDHKTRMVNEAVA
IPD113Eac  (263)  -CRPDVSHATVEDKISGAIFSFQATNRNSTTIFSAICEDHKTRMVNEAVA
IPD113Ey   (263)  -CRPDVSHATVEDKISGAIFSFQATNRNSTTIFSAICEDHKTRMVNEAVA
IPD113Eab  (263)  -CRPDVSHATVEDKISGAIFSFQATNRNSTTIFSAICEDHKTRMVNEAVA
IPD113Eu   (271)  -CRPNVSHATVEDKISGAIFTFQATNQNSTTIFSAICEDHKTRMVNEAVA
IPD113Ex   (271)  -CRPNVSHATVEDKISGAIFTFQATNQNSTTIFSAICEDHKTRMVNEAVA
IPD113Ev   (271)  -CRPNVSHATVEDKISGAIFTFQATNQNSTTIFSAICEDHKTRMVNEAVA
IPD113Ew   (271)  -CRPNVSHATVEDKISGAIFTFQATNQNSTTIFSAICEDHKTRMVNEAVA
IPD113De   (269)  -CRPNVSHATVEDKISGAIFSFQSSGSSTTMFSEICEDHKTRMVNEAIA
IPD113Df   (269)  -CRPNVSHATVEDKISGAIFSFQSSGSSTTMFSEICEDHKIRMVNEAIA
IPD113Dg   (266)  -CRPNVSHATVEDKISGAIFSFQSSGSSTTMFSEICEDHKTRMVNEAIA
IPD113Dm   (269)  -CRPNVSHATVEDKISGALFSFQSTGSSTTMFSEVCEDHKTRMVNEAIA
IPD113Dn   (266)  -CRPNVSHATVEDKISGALFSFQSTGSSTTMFSEVCEDHKTRMVNEAIA
IPD113Dam  (233)  -CRPDVSYATVEDKISGALFSFQATNRNSTTLFIEVCEDHKTRMVNEAIA
IPD113Db   (256)  -CRPDVSYATVEDKISGALFSFQATNRNSTTLFIEVCEDHKTRMVNEAIA
IPD113Dap  (233)  -CRPDVSYATVEDKISGALFSFQATNRNSTTIFIEVCEDHKTRMVNEAIA
IPD113Ee   (272)  -CRPDVSYATVEDKISGALFSFQATNRNSTTIFIEVCEDHKTRMVNEAIA
IPD113Ef   (272)  -CRPDVSYATVEDKISGALFSFQATNRNSTTIFIEVCEDHKTRMVNEAIA
IPD113Eg   (272)  -CRPDVSYATVEDKISGALFSFQATNRNSTTIFIEVCEDHKTRMVNEAIA
IPD113Daq  (233)  -CRPDVSYATVEDKISGALFSFQATNRNSTTIFIEVCEDHKTRMVNEAIA
IPD113Do   (270)  -CRPDVSFATVEDKISGALFSFQAANRNSTTIFIEVCEDHKTRMVNEAIA
IPD113Dd   (273)  -CRPDISYATVEDKISGALFSFQATNRNSTTIFIEVCEDHKTRMMNEAVA
IPD113Dak  (233)  -CRPDVSYATVEDKISGALFSFQATNRNSTTIFSEVCEDHKTRMVNEAIA
IPD113Dh   (259)  -CRPDVSYATVEDKISGALFSFQATNRNSTTIFSEVCEDHKTRMVNEAIA
                   ▲                                                    ▲
```

Fig. 4H

```
              351                                                    400
IPD113Da  (320) DMASCLSPTFAFHKLLPDDIQTQFSPYDRQQFGQVFRGPYSQDLSHGLWT
IPD113Dai (308) DMASCLSPTFAFHKLLPDDIQTQFSPYDRQQFGQVFRGPYSQDLSHGLWT
IPD113Dal (282) DMASCLSPTFAFHKLLPDDIQTQFSPYDRQQFGQVFRGPYSQDLSHGLWT
IPD113Daj (321) DMASCLSPTFAFHKLLPDDIQTQFSPYDRQQFGQVFRGPYSQDLSHGLWT
IPD113Dc  (309) DMASCLSPTFAFHKLLPDDIQTQFSPYDRQQFGQVFRGPYSQDLSHGLWT
IPD113Dae (306) DMASCLSPTFAFHKLLPDDIQAKFSPYDREQFGKVFRGPYSEDLSHGKWT
IPD113Dah (306) DMASCLSPTFAFHKLLPDDIQAKFSPYDREQFGKVFRGPYSEDLSHGKWT
IPD113Daf (306) DMASCLSPTFAFHKLLPDDIQAKFSPYDREQFGKVFRGPYSEDLSHGKWT
IPD113Dag (306) DMASCLSPTFAFHKLLPDDIQAKFSPYDREQFGKVFRGPYSEDLSHGKWT
IPD113Dan (304) DMASCLSPTFAFHKLLPNDIQKFSKYDREQFGQVFRGPYSQDLSHGKWK
IPD113Ead (305) DMASCLSPTFAFHKLLPAKIQKFSAFDREQFGQVFRGPYSEDLSHGKWK
IPD113Eh  (304) DMASCLSPTFAFHKLLPKKIQKFSAFDREQFGQVFRGPYSEDLSHGKWK
IPD113Dao (303) DMASCLSPTFAFHKLLPDDIQKFSAFDREQFGQVFRGPYSQDLSHGKWT
IPD113Es  (304) DMASCLSPTFAFHKLLPKDIQKFSAFDREQFGQVFRGPYSQDLSHGKWT
IPD113Di  (309) DMASCLSPTFAFHKLLPDKIQKFSAFDREQFGQVFRGPYSEDLSHGKWT
IPD113Dk  (309) DMASCLSPTFAFHKLLPDKIQKFSAFDREQFGQVFRGPYSEDLSHGKWT
IPD113Dj  (309) DMASCLSPTFAFHKLLPDKIQKFSAFDREQFGQVFRGPYSEDLSHGKWT
IPD113Dl  (309) DMASCLSPTFAFHKLLPDDIQTQFSPYDREQFGKVFRGPYSEDLSHGKWT
IPD113Ds  (336) DMASCLSPTFAFHKLLPDKIQTQFSPYDREQFGKVFRGPYSQDLSHGKWT
IPD113Du  (332) DMASCLSPTFAFHKLLPDKIQTQFSPYDREQFGKVFRGPYSQDLSHGKWT
IPD113Dp  (318) DMASCLSPTFAFHKLLPDKIQAQFSKYDREQFGKVFRGPYSQDLSHGKWT
IPD113Eaa (312) DMASCLSPTFAFHKLLPKKIQKQFKAFDREQFGQVFRGPYSQDLSHGKWT
IPD113Ez  (312) DMASCLSPTFAFHKLLPKKIQKQFKAFDREQFGQVFRGPYSQDLSHGKWT
IPD113Eac (312) DMASCLSPTFAFHKLLPKKIQKQFKAFDREQFGQVFRGPYSQDLSHGKWT
IPD113Ey  (312) DMASCLSPTFAFHKLLPKKIQKQFKAFDREQFGQVFRGPYSQDLSHGKWT
IPD113Eab (312) DMASCLSPTFAFHKLLPKKIQKQFKAFDREQFGQVFRGPYSQDLSHGKWT
IPD113Eu  (320) DMASCLSPTFAFHKLLPDKIQKQFSKYDREQFGQVFRGPYSQDLSHGKWK
IPD113Ex  (320) DMASCLSPTFAFHKLLPDKIQKQFSKYDREQFGQVFRGPYSQDLSHGKWK
IPD113Ev  (320) DMASCLSPTFAFHKLKPDKIQKQFSKYDREQFGQVFRGPYSQDLSHGKWK
IPD113Ew  (320) DMASCLSPTFAFHKLLPDKIQKQFSKYDREQFGQVFRGPYSQDLSHGKWK
IPD113De  (318) DMASCLSPTFAFHKLLPDDIQKQFSPYDRQEFGQVFRGPYSQDLSHGKWT
IPD113Df  (318) DMASCLSPTFAFHKLLPDDIQKQFSPYDRQEFGQVFRGPYSQDLSHGKWT
IPD113Dg  (315) DMASCLSPTFAFHKLLPDDIQKQFSPYDRQEFGQVFRGPYSQDLSHGKWT
IPD113Dm  (318) DMASCLSPTFAFHKLLPDDIQAQFSPYDRQEFGQVFRGPYSQDLSHGLWT
IPD113Dn  (315) DMASCLSPTFAFHKLLPDDIQKQFSPYDRQEFGQVFRGPYSQDLSHGLWT
IPD113Dam (282) DMASCKSPTFAKHKKLPDDVKTKFSPYDRKKFGKVKRGPYSQDLSHGLWT
IPD113Db  (305) DMASCLSPTFAFHKLLPDDIQTQFSPYDRQQFGQVFRGPYSQDLSHGLWT
IPD113Dap (282) DMASCLSPTFAFHKLLPDKIQKQFSPYDRQQFGQVLRGPYSQDLSHGLWT
IPD113Ee  (321) DMASCLSPTFAFHKLLPDKIQAQFSPYDRQQFGQVLRGPYSQDLSHGLWT
IPD113Ef  (321) DMASCLSPTFAFHKLLPDKIQAQFSPHDRQQFGQVLRGPYSQDLSHGLWT
IPD113Eg  (321) DMASCLSPTFAFHKLLPDKIQAQFSPYDRQQFGQVLRGPYSQDLSHGLWT
IPD113Daq (282) DMASCLSPTFAFHKLLPDKIQAQFSPYDRQQFGQVLRGPYSQDLSHGLWT
IPD113Do  (319) DMASCLSPTFAFHKLLPDDIQKQFSPYDRQQFGQVFRGPYSQDLSHGLWT
IPD113Dd  (322) DMASCLSPTFAFHKLLPNDIQTQFSPYDRQQFGQVFRGPYSEDLSHGLWT
IPD113Dak (282) DMASCLSPTFAFHKLLPDDIQTQFSPYDRQQFGQVFRGPYSQDLSHGLKT
IPD113Dh  (308) DMASCLSPTFAFHKLLPDDIQTQFSPYDRQQFGQVFRGPYSQDLSHGLWT
```

Fig. 4I

```
                     401                                                    450
IPD113Da    (370)    VFKSFRSRTTRSDQTLRDRILEVIIRAGHHVDAIQFVYDHVNPNSTTPGI
IPD113Dai   (358)    VFKSFRSRTTRSDQTLRDRILEVIIRAGHHVDAIQFVYDHVNPNSTTPGI
IPD113Dal   (332)    VFKSFRSRTTRSDQTLRDRILEVIIRAGHHVDAIQFVYDHVNPNSTTPGI
IPD113Daj   (371)    VFKSFRSRTTRSDQTLRDRILEVIIRAGHHVDAIQFVYDHVNPNSTTPGI
IPD113Dc    (359)    VFKSFRSRTTRSDQTLRDRILEVIIRAGHHVDAIQFVYDHVNPNSTTPGI
IPD113Dae   (356)    VNKAFRSHTTRSDQTARDRILEVIIRAEHHVDAIQFMYDHVNPNATTPGI
IPD113Dah   (356)    VNKAFRSHTTRSDQTARDRILEVIIRAEKVDAIQFMYDHVNPNATTPGI
IPD113Daf   (356)    VNKAFRSHTTRSDQTARDRILEVIIRAEAHVDAIQFMYDHVNPNATTPGI
IPD113Dag   (356)    VNKAFRSHTTRSDQTARDRILEVIIRAEAHVDAIQFMYDHVNPNATTPGI
IPD113Dan   (354)    NHKAFRSHTTRSDQTNRDRILQVIIRAGHHVDAIQFMYDHANBNALTPGI
IPD113Ead   (355)    NLKAFRSHTTRSDQTNRDRILQVIIRAGHHVDAIQFMYDHANBNALTPGI
IPD113Eh    (354)    NLKAFRSHTTRSDQTNRDRILQVIIRAGHHVDAIQFMYDHANBNALTPGI
IPD113Dao   (353)    ILKAFRSHTTRSDQTNRDRILEMIIRAGSHVDAIQFMYDHANPNATAGI
IPD113Es    (354)    ILKAFRSHTTRSDQTNRDRVLEMIIRAGSHVDAIQFMYDHANPNATTAGI
IPD113Di    (359)    ALKSFRSHTTRSDQTNRDRILEVIIRAGSHVDAIQFMYDHANPNANTAGI
IPD113Dk    (359)    ALKSFRSHTTRSDQTNRDRILEVIIRAGSHVDAIQFMYDHANPNANTAGI
IPD113Dj    (359)    ALKSFRSHTTRSDQTNRDRILEVIIRAGSHVDAIQFMYDHANPNANTAGI
IPD113Dl    (359)    AVKSFRSHTTREDQTARDRILQVIIRAGSHVDAIQFNYDHVNNNANTAGT
IPD113Ds    (386)    VLKAFRSHTTREDQTARDRILEMIIRAGSHVDAIQFNYDHVNNNSNTPGI
IPD113Du    (382)    VLKAFRSHTTREDQTARDRILEMIIRAGSHVDAIQFNYDHVNNNSNTPGI
IPD113Dp    (368)    SLKSFRSRFTREDQTARDRILEVIIRAGSHIDAIQFNYDHANNNSNTAGV
IPD113Eaa   (362)    ILKSFRSHFTREDNTVRDRVLEINIRAGHHVDAINFNYDHLNPNSMTAGI
IPD113Ez    (362)    TLKSFRSNFTREDNTVRDRVLEINIRAGHHVDAINFNYDHLNPNSNTAGI
IPD113Eac   (362)    ILKSFRSHFTREDNTVRDRVLEINIRAGHHVDAINFNYDHLNPNSNTAGI
IPD113Ey    (362)    ILKSFRSHFTREDNTVRDRVLEINIRAGHHVDAINFNYDHLNPNSNTAGI
IPD113Eab   (362)    ILKSFRSHFTREDNTVRDRVLEINIRAGHHVDAINFNYDHLNPNSNTAGI
IPD113Eu    (370)    NLKSFRSRFTSEDQTARDRVLEMNIRAGHHVDAINFNYDHANNNSNTAGV
IPD113Ex    (370)    NLKSFRSRFTSEDQTARDRVLEVNIRAGHHVDAINFNYDHANNNSNTAGV
IPD113Ev    (370)    NLKSFRSRFTSEDQTARDRVLEVNIRAGHHVDAINFNYDHANNNSNTAGV
IPD113Ew    (370)    NLKSFRSRFTSEDQTARDRVLEVNIRAGHHVDAINFNYDHANNNSNTAGV
IPD113De    (368)    NFKNFRSRTTRSDQTLRDRILEVIIRAGSHVDALQFIYDHVNPNSMTPGI
IPD113Df    (368)    NFKNFRSRTTRSDQTLRDRILEVIIRAGSHVDALQFIYDHVNPNSMTPGI
IPD113Dg    (365)    NFKNFRSRTTRSDQTLRDRILEVIIRAGSHVDALQFMYDHVNPNSTTPGV
IPD113Dm    (368)    NFKNFRSRTTRSDQTLRDRILEVIIRAGSHVDAIQFVYDHANPNSTTNGN
IPD113Dn    (365)    NFKNFRSRTTRSDQTLRDRILEVIIRAGSHVDAIQFVYDHANPNSTTNGN
IPD113Dam   (332)    AFKNFRSRTTRSDQTLRDRILEVIIRAGHHVDAIQFVYDHSNPNNTTPGN
IPD113Db    (355)    AFKNFRSRTTRSDQTLRDRILEVIIRAGHHVDAIQFVYDHSNPNNTTPGN
IPD113Dap   (332)    VFKSFRSRTTRSDQTLRDRILEVIIRAGHHVDAIQFVYDHANPNLTTNGN
IPD113Ee    (371)    VFKSFRSRTTRSDQTLRDRILEVIIRAGHHVDAIQFVYDHANPNNTTPGN
IPD113Ef    (371)    VFKSFRSRTTRSDQTLRDRILEVIIRAGHHVDAIQFVYDHANPNNTTPGN
IPD113Eg    (371)    VFKSFRSRTTRSDQTLRDRILEVIIRAGHHVDAIQFVYDHANPNNTTPGN
IPD113Daq   (332)    VFKSFRSRTTRSDQTLRDRILEVIIRAGHHVDAIQFVYDHANPNNTTSGN
IPD113Do    (369)    VFKSFRSRTTRSDQTNRDRILEVIIRAGHHVDAIQFMYDHANPNNTTPGN
IPD113Dd    (372)    VFKSFRSRTTRSDQTLRDRILEVIIRAGHHVDAIQFVYDHVNPNSTTPGI
IPD113Dak   (332)    VFKSFRSRTTRSDQTLRDRILEVIIRAGHHVDAIQFVYDHVNPNSTTPGI
IPD113Dh    (358)    VFKSFRSRTTRSDQTLRDRILEVIIRAGHHVDAIQFVYDHVNPNSTTPGI
```

Fig. 4J

```
                         451                                                     500
IPD113Da   (420)  VAGNAAGGTRHQIDVRDRPIKEVRMEFSQDVLASLQLHFEDGTSTRKFGN
IPD113Dai  (408)  VAGNAAGGTRHQIDVRDRPIKEVRMEFSQDVLASLQLHFEDGTSTRKFGN
IPD113Dal  (382)  VAGNAAGGTRHQIDVRDRPIKEVRMEFSQDVLASLQLHFEDGTSTRKFGN
IPD113Daj  (421)  VAGNAAGGTRHQIDVRDRPIKEVRMEFSQDVLASLQLHFEDGTSTRKFGN
IPD113Dc   (409)  VAGNAAGGTRHQIDVRDRPIKEVRMEFSQDVLASLQLHFEDGTSTRKFGN
IPD113Dae  (406)  MAGNTTGSRYEVDVRDRPIQELRMEFSNVLASLQLHFQDGTATQKFGN
IPD113Dah  (406)  MAGNTTGSRYEVDVRDRPIQELRMEFSNVLASLQLHFQDGTATQKFGN
IPD113Daf  (406)  MAGNTTGSRYEVDVRDRPIQELRMEFSNVLASLQLHFQDGTATQKFGN
IPD113Dag  (406)  MAGNTTGSRYEVDVRDRPIQELRMEFSNVLASLQLHFQDGTATQKFGN
IPD113Dan  (404)  IAGNSAGGRHQVDVRDPPMQELRMEFSDVLASLQIHFEDGTSTRKFGN
IPD113Ead  (405)  IAGNSAGGRHEVNVRDPPMQELRMEFADVLASLQIHFEGGTSTRKFGN
IPD113Eh   (404)  IAGNSAGGRHEVNVRDPPMQELRMEFADVLASLQIHFEGGTSTRKFGN
IPD113Dao  (403)  MAGNTTGGNRHHVDVRGRPIRELRMFADVMSSLQLHFEDGTATRKFGN
IPD113Es   (404)  MAGNSAGGNRHRVDVRGRIIRELRMAFADVISSLQLFEDGTATRRFGN
IPD113Di   (409)  MAGNSAGGRYNVDVRGRPIQELRMAFANDVLASLQLHFEDGTSTRRFGN
IPD113Dk   (409)  MAGNSAGGRYNVDVRGRPIQELRMAFANDVLASLQLHFEDGTSTRRFGN
IPD113Dj   (409)  MAGNSAGGRYNVDVRGRPIQELRMAFANDVLASLQLHFEDGTSTRRFGN
IPD113Dl   (409)  MAGNSGGNRHEVDVRNRPIQELRMEFADVLASLQLRFEDGTSTRRFGN
IPD113Ds   (436)  MAGNSNGGRHQVDVRGRPIQETRMEFAKDVLASLQLHFEDGTSTREFGN
IPD113Du   (432)  MAGNSMGGRHQVDVRGRPIQETRMEFAKDVLASLQLHFEDGTSTRRFGN
IPD113Dp   (418)  MAGNESGGRYQVDVRGRLIQDLRMEFSDVLAALQLRFIDGSSTNFGN
IPD113Eaa  (412)  MAGNASGGVHQVDMRGRKLQDLRMEFSHDILAALQLHFKDGTSTRKFGN
IPD113Ez   (412)  MAGNASGGVHQVDMRGRTIQDLRMEFSHDILAALQLHFHDGTSTRKFGN
IPD113Eac  (412)  MAGNASGGVHQVDMRGRVLQDLRMEFSQDILAALQLHFHDGTSTRKFGN
IPD113Ey   (412)  MAGNASGGVHQVDMRGRILQDLRMEFSQDILAALQLHFHDGTSTRKFGN
IPD113Eab  (412)  MAGNASGGVHQVDMRGRLQDLRMEFSQDILAALQLHFHDGTSTRKFGN
IPD113Eu   (420)  MAGNPVGGVHQVDVRGRIIQDLRMEFSHDILAALQLHFIDGTSTRKFGN
IPD113Ex   (420)  MAGNPVGGVHQVDVRGRIIQDLRMEFSHDILAALQLHFIDGTSTRKFGN
IPD113Ev   (420)  MAGNPVGGVHQVDLRGRIIQDLRMEFSHDILAALQLHFIDGTSTRKFGN
IPD113Ew   (420)  MAGNPVGGVHQVDLRGRIIQDLRMEFSHDILAALQLHFIDGTSTRKFGN
IPD113De   (418)  MAGNAAGGRHQVDVRDRPIQEVRMEFANDVLASLQLHFEDGTSTQKFGN
IPD113Df   (418)  MAGNAAGGTRHQVDVRDRPIQEVRMEFANDVLASLQLHFEDGTSTQKFGN
IPD113Dg   (415)  MAGNAAGGRHQVDVRDRPIQEVRMEFANDVLASLQLHFEDGTSTQKFGN
IPD113Dm   (418)  LAGNATGGNRHQVDVRDPPIQELRMEFAKDVLASLQLHFEDGTSTQKFGN
IPD113Dn   (415)  LAGNATGGNRHQVDVRDPPIQELRMEFAKDVLASLQLHFEDGTSTQKFGN
IPD113Dam  (382)  VAGNAAGGTRHQVDVRDRPIQELRMEFSQDVLASLQLHFQDGTSTRKFGN
IPD113Db   (405)  VAGNAAGGTRHQVDVRDRPIQELRMEFSQDVLASLQLHFEDGTSTRKFGN
IPD113Dap  (382)  VAGNATGGSRHQVDVRDRPIQEVRMEFSQDVLASLQLHFEDGTSTRKFGN
IPD113Ee   (421)  VAGNAAGGSHQVDVRDRPIQEVRMEFSQDVLASLQLHFEDGTSTRKFGN
IPD113Ef   (421)  VAGNAAGGSHQVDVRDRPIQEVRMEFSQDVLASLQLHFEDGTSTRKFGN
IPD113Eg   (421)  VAGNAAGGSHQVDVRDRPIQEVRMEFSQDVLASLQLHFEDGTSTRKFGN
IPD113Daq  (382)  VAGNATGGSRHQVDVRDRPIQEVRMEFSQDVLASLQLHFEDGTSTRKFGN
IPD113Do   (419)  VAGNAAGGSRHQVDVRNRPIQEVRMEFSQDVLASLQLHFEDGTSTRKFGN
IPD113Dd   (422)  VAGNAAGGTRHQVDVRDRPIQELRMEFSQDVLASLQLHFEDGTSTRKFGN
IPD113Dak  (382)  VAGNAAGGTRHQIDVRDRPIKEVRMEFSQDVLASLQLHFEDGTSTRKFGN
IPD113Dh   (408)  VAGNAAGGTRHQIDVRDRPIKEVRMEFSQDVLASLQLHFEDGTSTRKFGN
```

Fig. 4K

```
                  501                                                      550
IPD113Da   (470)  ELG--WATRILTCTVPYGYRFSSWAFREDPGPYRTTAISVLRFQFTPELD
IPD113Dai  (458)  ELG--WATRILTCTVPYGYRFSSWAFREDPGPYRTTAISVLRFQFTPELD
IPD113Dal  (432)  ELG--WATRILTCTVPYGYRFSSWAFREDPGPYRTTAISVLRFQFTPELD
IPD113Daj  (471)  ELG--WATRILTCTVPYGYRFSSWAFREDPGPYRTTAISVLRFQFTPELD
IPD113Dc   (459)  ELG--WATRILTCTVPYGYRFSSWAFREDPGPYRTTAISVLRFQFTPELD
IPD113Dae  (456)  ING--WASRILTCTAPYGYRFSSWAFHEDPGPWRTTAISVLRFQFTPELD
IPD113Dah  (456)  VNG--WASRILTCTAPYGYRFSSWAFHEDPGPWATTAISVLRFQFTPELD
IPD113Daf  (456)  ING--WASRILTCTAPYGYRFSSWAFHEDPGPWATTAISVLRFQFTPELD
IPD113Dag  (456)  ING--WASRILTCTAPYGYRFSSWAFHEDPGPWATTAISVLRFQFTPELD
IPD113Dan  (454)  ELG--WATRILTCTAPYGYRFSSWAFREDAGPYRTTAISVLRFQFTPELD
IPD113Ead  (455)  ELG--WASRILTCTAPYGYRFSSFAFREDAGPYRTTAISVLRFQFTPELD
IPD113Eh   (454)  ELG--WASRILTCTAPYGYRFSSFAFREDAGPYRTTAISVLRFQFTPELD
IPD113Dao  (453)  EHG--WASRILTCTVPYGYRLSSWAFREDPGPYRTTAISVLRFQFTPELD
IPD113Es   (454)  EHG--WASRILTCTVPYGYRLSSWAFREDPGPYRTTAISVLRFQFTPELD
IPD113Di   (459)  DVG--WASRILTCTAPYGYRFSSWAFREDPGPYGSTAISVLRFQFTPELD
IPD113Dk   (459)  DVG--WASRILTCTAPYGYRFSSWAFREDPGPYGSTAISVLRFQFTPELD
IPD113Dj   (459)  DVG--WASRILTCTAPYGYRFSSWAFREDPGPYGSTAISVLRFQFTPELD
IPD113Dl   (459)  DGW---ATRILTCTAPYGYRLSSWAFREDPGPYRTTAISVLRFQFTPELD
IPD113Ds   (486)  DGW---ATRILTCTAPYGYRLSSWAFREDPGPYRTTAISVLRFQFTPELD
IPD113Du   (482)  DGW---ATRILTCTAPYGYRLSSWAFREDPGPYRTTAISVLRFQFTPELD
IPD113Dp   (468)  ANG--WSTRIVTCTAPYGYRLSSWAFREDAGPYRTAAISVLRFQFTPELD
IPD113Eaa  (462)  ELG--WASRILTCTAPYGYRLSSWAFRQDAGPYRTAAISVLRFQFTPELD
IPD113Ez   (462)  ELG--WASRILTCTAPYGYRLSSWAFRQDAGPYRTAAISVLRFQFTPELD
IPD113Eac  (462)  ELG--WASRILTCTVPYGYRLSSWAFRQDAGPYRTAAISVLRFQFTPELD
IPD113Ey   (462)  ELG--WASRILTCTAPYGYRLSSWAFRQDAGPYRTAAISVLRFQFTPELD
IPD113Eab  (462)  ELG--WASRILTCTVPYGYRLSSWAFRQDAGPYRTAAISVLRFQFTPELD
IPD113Eu   (470)  ELG--WASRILTCTAPYGYRLSSWAFRQDAGPYRTAAISVLRFQFTPELD
IPD113Ex   (470)  ELG--WASRILTCTAPYGYRLSSWAFRQDAGPYRTAAISVLRFQFTPELD
IPD113Ev   (470)  ELG--WASRILTCTAPYGYRLSSWAFRQDAGPYRTAAISVLRFQFTPELD
IPD113Ew   (470)  ELG--WASRILTCTAPYGYRLSSWAFRQDAGPYRTAAISVLRFQFTPELD
IPD113De   (468)  ELGGTWATRILTCTAPYGYRFSSWAFREDPGPYRTTAISVLRFQFTPELD
IPD113Df   (468)  ELGGTWATRILTCTAPYGYRFSSWAFREDPGPYRTTAISVLRFQFTPELD
IPD113Dg   (465)  ELGGTWATRILTCTAPYGYRFSSWAFREDPGPYRTTAISVLRFQFTPELD
IPD113Dm   (468)  ILGGTWATRILTCTAPYGYRFSSWAFREDPGPYRTTAISVLRFQFTPELD
IPD113Dn   (465)  ILGGTWATRILTCTAPYGYRFSSWAFREDPGPYRTTAISVLRFQFTPELD
IPD113Dam  (432)  ELG--WATRILTCTAPYGYRFSSWAFREDPGPYRTTAISVLRFQFTPELD
IPD113Db   (455)  ELG--WATRILTCTAPYGYRFSSWAFREDPGPYRTTAISVLRFQFTPELD
IPD113Dap  (432)  ELG--WATRILTCTAPYGYRFSSWAFREDPGPYRTTAISVLRFQFTPELD
IPD113Ee   (471)  ELG--WATRILTCTAPYGYRFSSWAFREDPGPYRTTAISVLRFQFTPELD
IPD113Ef   (471)  ELG--WATRILTCTAPYGYRFSSWAFREDPGPYRTTAISVLRFQFTPELD
IPD113Eg   (471)  ELG--WATRILTCTAPYGYRFSSWAFREDPGPYRTTAISVLRFQFTPELD
IPD113Daq  (432)  ELG--WATRILTCTAPYGYRFSSWAFREDPGPYRTTAISVLRFQFTPELD
IPD113Do   (469)  ELG--WATRILTCTAPYGYRFSSWAFREDPGPYRTTAISVLRFQFTPELD
IPD113Dd   (472)  ELG--WATRILTCTAPYGYRLSSWAFREDPGPYRTTAISVLRFQFTPELD
IPD113Dak  (432)  ELG--WATRILTCTVPYGYRFSSWAFREDPGPYRTTAISVLRFQFTPELD
IPD113Dh   (458)  ELG--WATRILTCTVPYGYRFSSWAFREDPGPYRTTAISVLRFQFTPELD
```

Fig. 4L

```
                         551
  IPD113Da   (518)  MPLP
  IPD113Dai  (506)  MPLP
  IPD113Dal  (480)  MPLP
  IPD113Daj  (519)  MPLP
  IPD113Dc   (507)  MPLP
  IPD113Dae  (504)  IPLS
  IPD113Dah  (504)  IPLS
  IPD113Daf  (504)  IPLS
  IPD113Dag  (504)  IPLS
  IPD113Dan  (502)  IPLP
  IPD113Ead  (503)  IPLP
  IPD113Eh   (502)  IPLP
  IPD113Dao  (502)  IPLP
  IPD113Es   (503)  IPLP
  IPD113Di   (507)  IPLP
  IPD113Dk   (507)  IPLP
  IPD113Dj   (507)  IPLP
  IPD113Dl   (506)  ITPP
  IPD113Ds   (533)  ITPP
  IPD113Du   (529)  ITPP
  IPD113Dp   (516)  FPVP
  IPD113Eaa  (510)  FPVP
  IPD113Ez   (510)  FPVP
  IPD113Eac  (510)  FPVP
  IPD113Ey   (510)  FPVP
  IPD113Eab  (510)  FPVP
  IPD113Eu   (518)  FPVP
  IPD113Ex   (518)  FPVP
  IPD113Ev   (518)  FPVP
  IPD113Ew   (518)  FPVP
  IPD113De   (518)  MPLP
  IPD113Df   (518)  MPLP
  IPD113Dg   (515)  MPLP
  IPD113Dm   (518)  MPLP
  IPD113Dn   (515)  MPLP
  IPD113Dam  (480)  MPLP
  IPD113Db   (503)  MPLP
  IPD113Dap  (480)  MPLP
  IPD113Ee   (519)  MPLP
  IPD113Ef   (519)  MPLP
  IPD113Eg   (519)  MPLP
  IPD113Daq  (480)  MPLP
  IPD113Do   (517)  MPLP
  IPD113Dd   (520)  MPLP
  IPD113Dak  (480)  MPLP
  IPD113Dh   (506)  FPLS
```

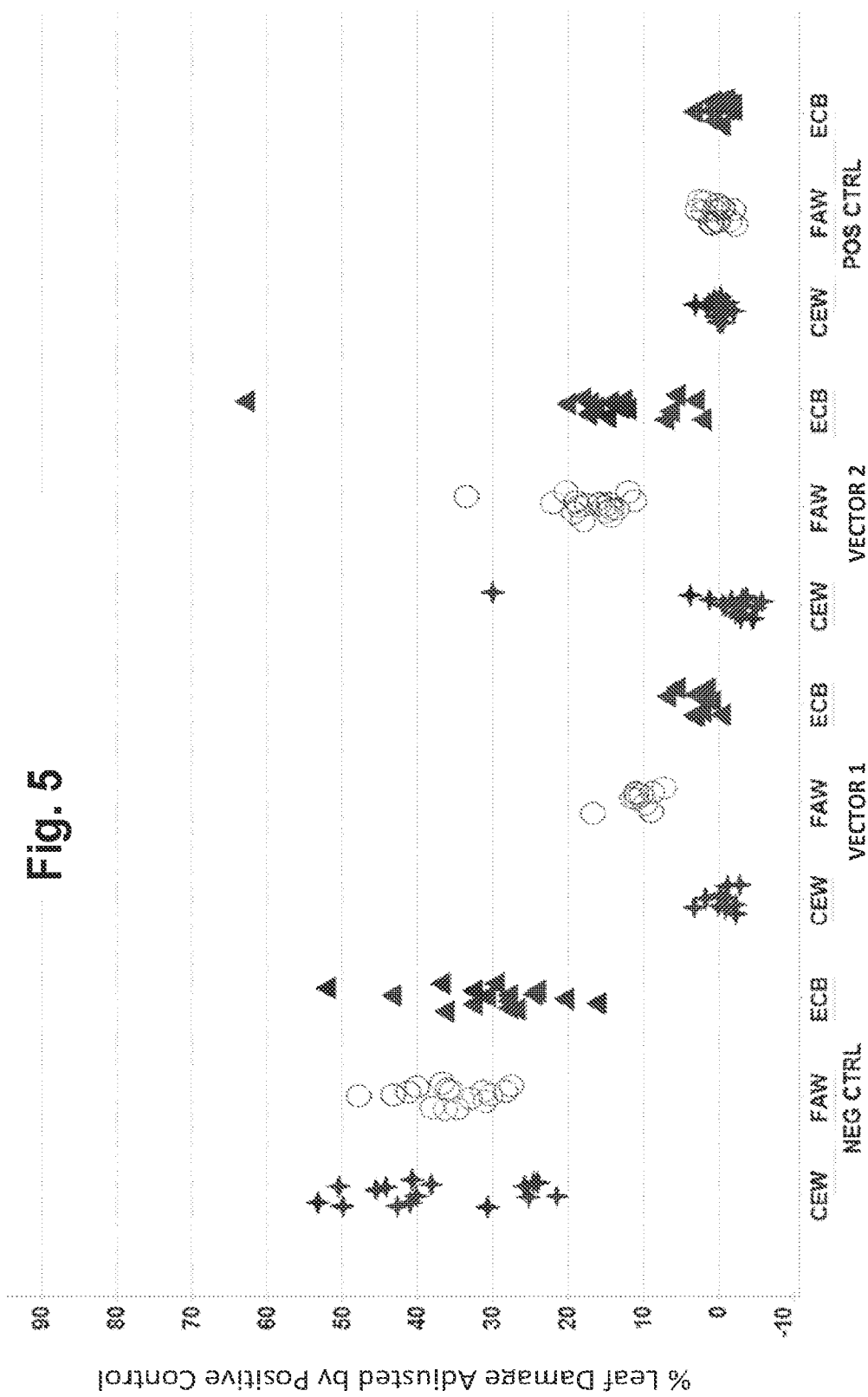

INSECTICIDAL PROTEINS FROM PLANTS AND METHODS FOR THEIR USE

CROSS REFERENCE

This application is a U.S. national stage application under 35 U.S.C. § 371(b) of International Application No. PCT/US2019/021775 filed Mar. 12, 2019, which claims the benefit of U.S. Provisional Application No. 62/642,642 filed Mar. 14, 2018, both of which are incorporated herein by reference in their entirety.

REFERENCE TO SEQUENCE LISTING SUBMITTED ELECTRONICALLY

The official copy of the sequence listing is submitted electronically via EFS-Web as an ASCII formatted sequence listing with a file named "RTS21844WOPCT_SequenceListing" created on Jan. 21, 2019, and having a size of 1,539 kilobytes and is filed concurrently with the specification. The sequence listing contained in this ASCII formatted document is part of the specification and is herein incorporated by reference in its entirety.

FIELD

This disclosure relates to the field of molecular biology. Provided are novel genes that encode pesticidal proteins. These pesticidal proteins and the nucleic acid sequences that encode them are useful in preparing pesticidal formulations and in the production of transgenic pest-resistant plants.

BACKGROUND

Biological control of insect pests of agricultural significance using a microbial agent, such as fungi, bacteria or another species of insect affords an environmentally friendly and a commercially attractive alternative to synthetic chemical pesticides. Generally speaking, the use of biopesticides presents a lower risk of pollution and environmental hazards and biopesticides provide greater target specificity than is characteristic of traditional broad-spectrum chemical insecticides. In addition, biopesticides often cost less to produce and thus improve economic yield for a wide variety of crops.

Certain species of microorganisms of the genus *Bacillus* are known to possess pesticidal activity against a range of insect pests including Lepidoptera, Diptera, Coleoptera, Hemiptera and others. *Bacillus thuringiensis* (Bt) and *Bacillus popilliae* are among the most successful biocontrol agents discovered to date. Insect pathogenicity has also been attributed to strains of *B. larvae, B. lentimorbus, B. sphaericus* and *B. cereus*. Microbial insecticides, particularly those obtained from *Bacillus* strains, have played an important role in agriculture as alternatives to chemical pest control.

Crop plants have been developed with enhanced insect resistance by genetically engineering crop plants to produce pesticidal proteins from *Bacillus*. For example, corn and cotton plants have been genetically engineered to produce pesticidal proteins isolated from strains of *Bacillus thuringiensis*. These genetically engineered crops are now widely used in agriculture and have provided the farmer with an environmentally friendly alternative to traditional insect-control methods. While they have proven to be very successful commercially, these genetically engineered, insect-resistant crop plants provide resistance to only a narrow range of the economically important insect pests. In some cases, insects can develop resistance to different insecticidal compounds, which raises the need to identify alternative biological control agents for pest control.

Accordingly, there remains a need for new pesticidal proteins with increased insecticidal activity, different spectrum of activity, and/or mode of action against insect pests, e.g., insecticidal proteins which are active against a variety of insects in the order Lepidoptera and the order Coleoptera including but not limited to insect pests that have developed resistance to existing insecticides.

SUMMARY

In one aspect, compositions and methods for conferring pesticidal activity to bacteria, plants, plant cells, tissues and seeds are provided. Compositions include nucleic acid molecules encoding sequences for pesticidal and insecticidal polypeptides, vectors comprising those nucleic acid molecules, and host cells comprising the vectors. Compositions also include the pesticidal polypeptide sequences and antibodies to those polypeptides. Compositions also comprise transformed bacteria, plants, plant cells, tissues and seeds.

In another aspect, isolated or recombinant nucleic acid molecules are provided encoding IPD113 polypeptides including amino acid substitutions, deletions, insertions, and fragments thereof. Provided are isolated or recombinant nucleic acid molecules capable of encoding IPD113 polypeptides of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494, and SEQ ID NO: 495, as well as amino acid substitutions, deletions, insertions, fragments thereof, and combinations thereof. Nucleic acid sequences that are complementary to a nucleic acid sequence of the embodiments or that hybridize to a sequence of the embodiments are also encompassed. The nucleic acid sequences can be used in DNA constructs or expression cassettes for transformation and expression in organisms, including microorganisms and plants. The nucleotide or amino acid sequences may be synthetic sequences that have been designed for expression in an organism including, but not limited to, a microorganism or a plant.

In another aspect, IPD113 polypeptides are encompassed. Also provided are isolated or recombinant IPD113 polypeptides of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494, and SEQ ID NO: 495, as well as amino acid substitutions, deletions, insertions, fragments thereof and combinations thereof.

In another aspect, methods are provided for producing the polypeptides and for using those polypeptides for controlling or killing a Lepidopteran, Coleopteran, nematode, fungi, and/or Dipteran pests. The transgenic plants of the embodiments express one or more of the pesticidal sequences disclosed herein. In various embodiments, the transgenic plant further comprises one or more additional genes for insect resistance, for example, one or more additional genes for controlling Coleopteran, Lepidopteran, Hemipteran or nematode pests. It will be understood by one of skill in the art that the transgenic plant may comprise any gene imparting an agronomic trait of interest.

In another aspect, methods for detecting the nucleic acids and polypeptides of the embodiments in a sample are also included. A kit for detecting the presence of an IPD113 polypeptide or detecting the presence of a polynucleotide encoding an IPD113 polypeptide in a sample is provided. The kit may be provided along with all reagents and control samples necessary for carrying out a method for detecting the intended agent, as well as instructions for use.

In another aspect, the compositions and methods of the embodiments are useful to produce organisms for the production of IPD113 polypeptides and transgenic plants with enhanced pest resistance or tolerance. These organisms and compositions comprising the organisms are desirable for agricultural purposes. The compositions of the embodiments are also useful for generating altered or improved proteins that have pesticidal activity or for detecting the presence of IPD113 polypeptides.

BRIEF DESCRIPTION OF THE FIGURES

FIG. 1C shows the IPD113Dh homolog family Phylogenic Tree and six closely related subgroups of the IPD113Dh homolog family members are boxed and indicated with different line dashing.

FIG. 2A-2D shows an amino acid sequence alignment, using the ALIGNX® module of the Vector NTI® suite, of selected members of the IPD113 homolog family: IPD113Aa (SEQ ID NO: 1); IPD113Ab (SEQ ID NO: 2); IPD113Bb (SEQ ID NO: 7); IPD113Bc (SEQ ID NO: 8); IPD113Db (SEQ ID NO: 10); IPD113Dh (SEQ ID NO: 16); IPD113Ei (SEQ ID NO: 39); IPD113Ej (SEQ ID NO: 40); IPD113Fa (SEQ ID NO: 41); IPD113Fl (SEQ ID NO: 49); IPD113Gg (SEQ ID NO: 59); and IPD113Gh (SEQ ID NO: 60). The sequence diversity is highlighted.

FIG. 3A-3C shows an amino acid sequence alignment, using the ALIGNX® module of the Vector NTI® suite, of the IPD113 homolog subgroup of: IPD113Aa (SEQ ID NO: 1); IPD113Ab (SEQ ID NO: 2); IPD113Ac (SEQ ID NO: 3); IPD113Ad (SEQ ID NO: 4); IPD113Ae (SEQ ID NO: 5); IPD113Ba (SEQ ID NO: 6); and IPD113Bb (SEQ ID NO: 7). The sequence diversity is highlighted. The two conserved cysteine (C) residues are indicated with a "▲" below the IPD113Bb sequence (SEQ ID NO: 7).

FIG. 4A-4L shows an amino acid sequence alignment, using the ALIGNX® module of the Vector NTI® suite, of the IPD113Dh homolog subgroups of FIG. 10: IPD113 Da (SEQ ID NO: 9); IPD113Db (SEQ ID NO: 10); IPD113Dc (SEQ ID NO: 11); IPD113Dd (SEQ ID NO: 12); IPD113De (SEQ ID NO: 13); IPD113Df (SEQ ID NO: 14); IPD113Dg (SEQ ID NO: 15); IPD113Dh (SEQ ID NO: 16); IPD113Di (SEQ ID NO: 17); IPD113Dj (SEQ ID NO: 18); IPD113Dk (SEQ ID NO: 19); IPD113Dl (SEQ ID NO: 20); IPD113Dm (SEQ ID NO: 21); IPD113Dn (SEQ ID NO: 22); IPD113Do (SEQ ID NO: 23); IPD113Dp (SEQ ID NO: 24); IPD113Ds (SEQ ID NO: 27); IPD113Du (SEQ ID NO: 30); IPD113Ee (SEQ ID NO: 35); IPD113Ef (SEQ ID NO: 36); IPD113Eg (SEQ ID NO: 37); IPD113Eh (SEQ ID NO: 38); IPD113Es (SEQ ID NO: 77); IPD113Dae (SEQ ID NO: 88); IPD113Daf (SEQ ID NO: 89); IPD113Dag (SEQ ID NO: 90); IPD113Dah (SEQ ID NO: 91); IPD113Eu (SEQ ID NO: 93); IPD113Ev (SEQ ID NO: 94); IPD113Ew (SEQ ID NO: 95); IPD113Ex (SEQ ID NO: 96); IPD113Dai (SEQ ID NO: 97); IPD113Daj (SEQ ID NO: 98); IPD113Dak (SEQ ID NO: 100); IPD113Dal (SEQ ID NO: 101); IPD113Dam (SEQ ID NO: 102); IPD113Ey (SEQ ID NO: 103); IPD113Ez (SEQ ID NO: 104); IPD113Eaa (SEQ ID NO: 105); IPD113Eab (SEQ ID NO: 106); IPD113Eac (SEQ ID NO: 107); IPD113Ead (SEQ ID NO: 110); IPD113Dan (SEQ ID NO: 111); IPD113Dao (SEQ ID NO: 112); IPD113Dap (SEQ ID NO: 113); and IPD113Daq (SEQ ID NO: 114). The sequence diversity is highlighted. The five conserved cysteine (C) residues are indicated with a "▲" below the IPD113Dh sequence (SEQ ID NO: 16).

FIG. 5 shows the % leaf damage by CEW, ECB and FAW of individual transgenic T0 maize events from constructs VECTOR 1 and VECTOR 2 expressing genes encoding the IPD113Dh polypeptide (SEQ ID NO: 2) compared to the negative control events containing the construct lacking a IPD113Dh polynucleotide (Empty). Each "+" symbol represents an individual event.

DETAILED DESCRIPTION

Figure 1A:
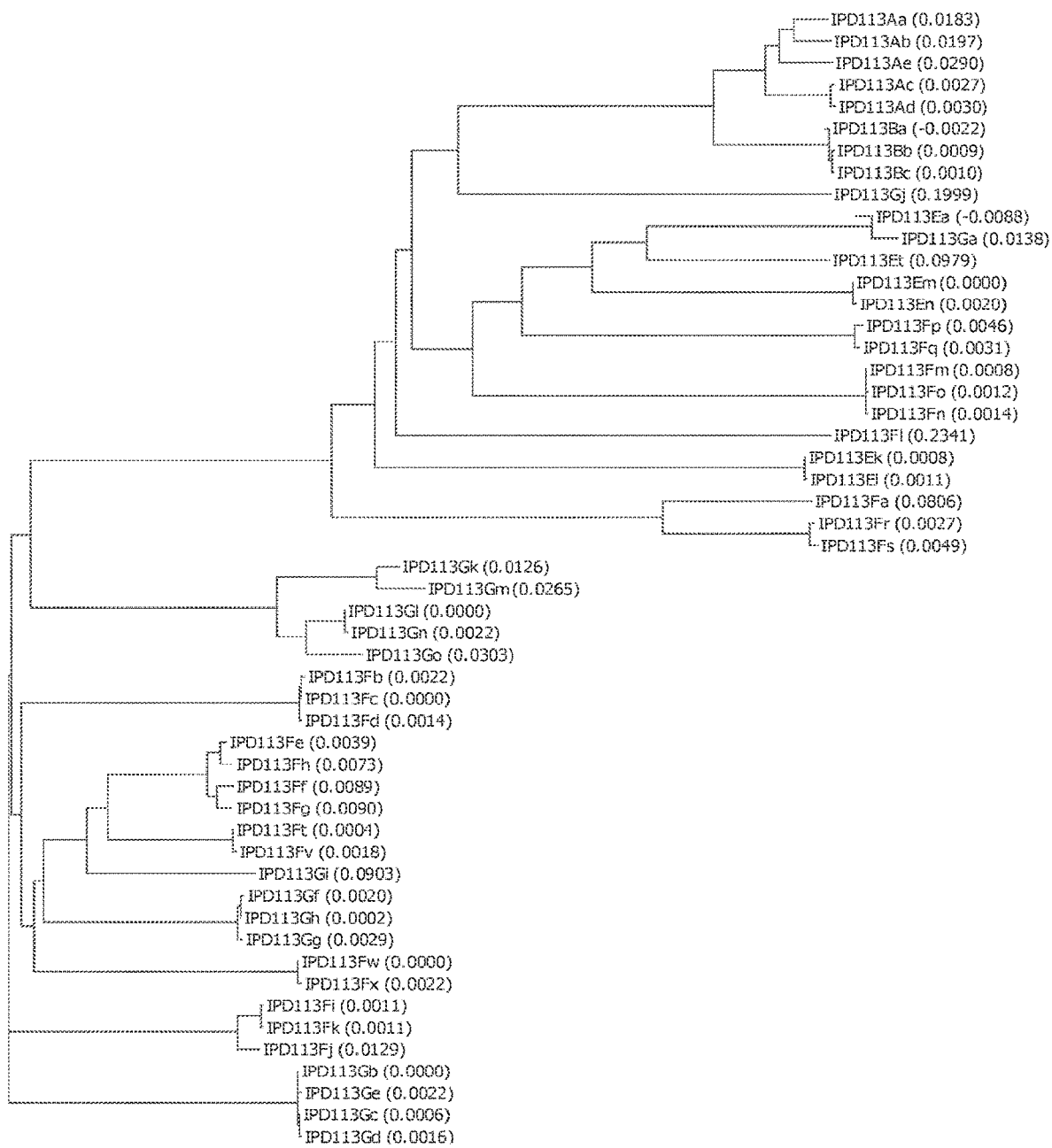
FIG. 1A-1C shows a Phylogentic Tree, using the Neighbor Joining Method in the ALIGNX® module of the Vector NTI® suite, of the IPD113 homologs of Table 3.
Figure 1B:
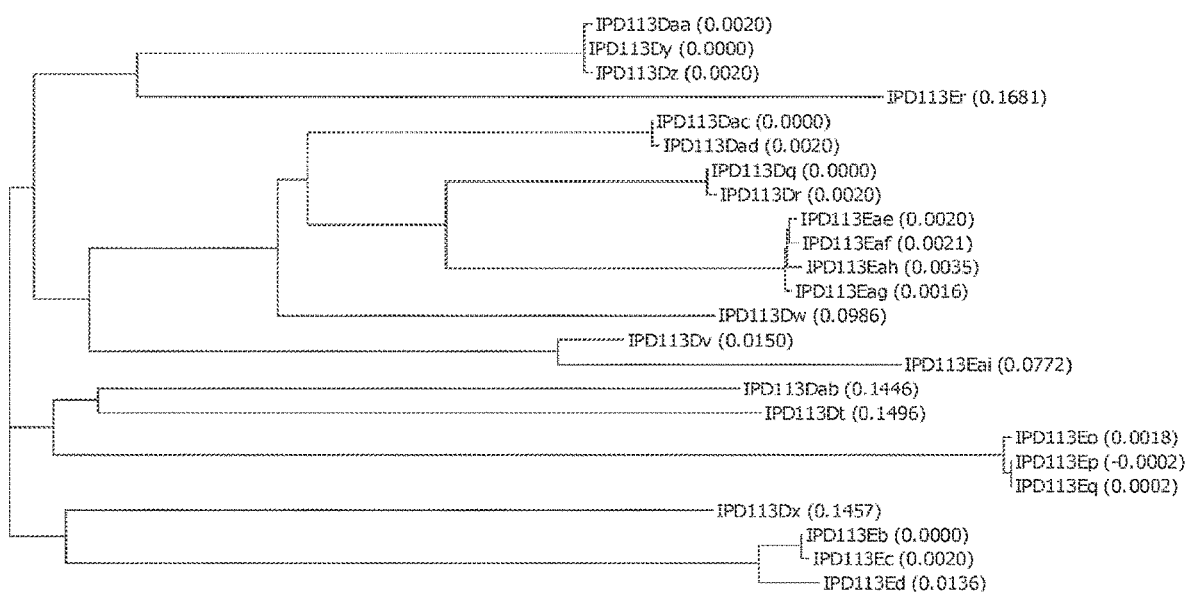
Figure 1C:
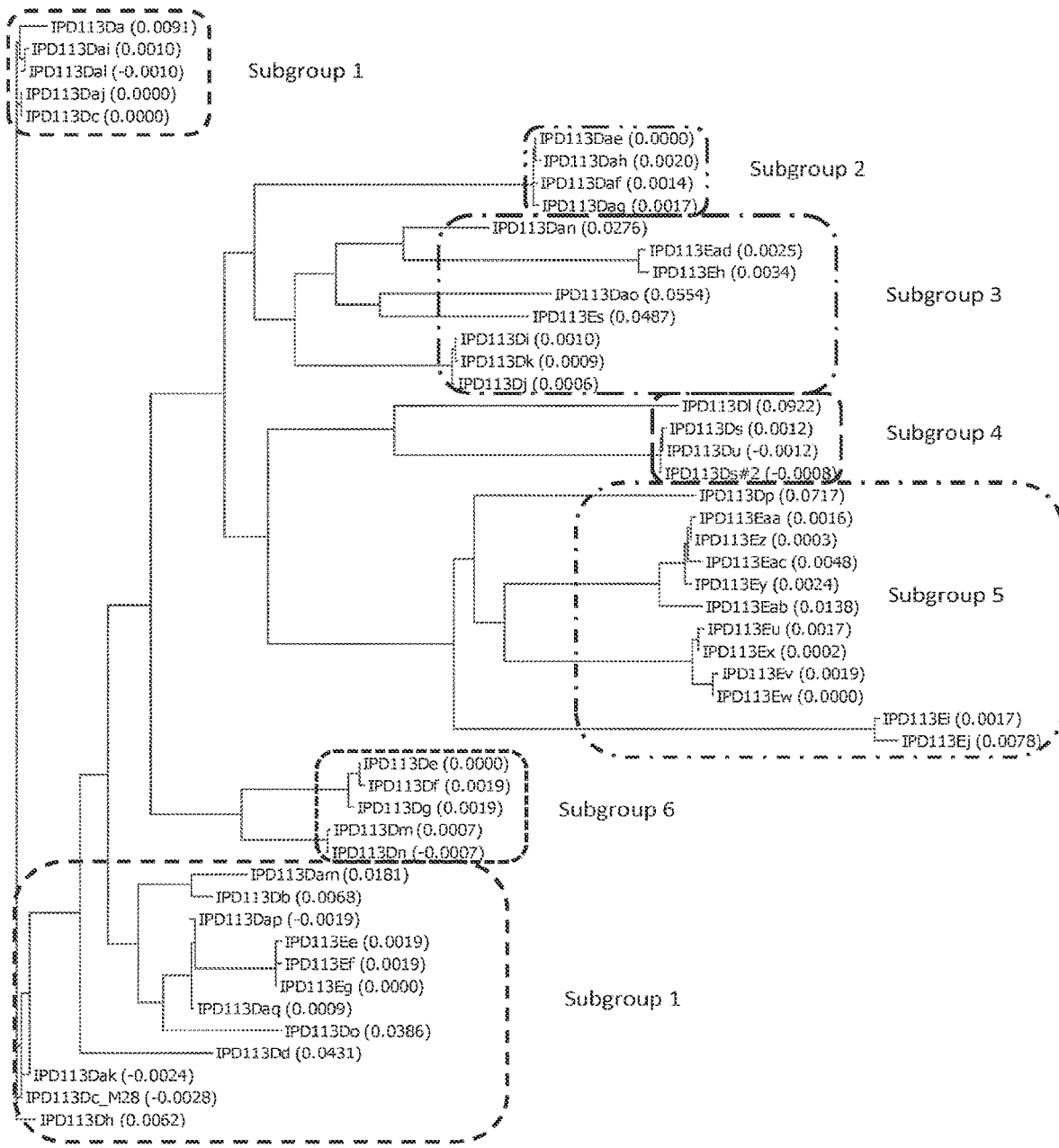

It is to be understood that this disclosure is not limited to the particular methodology, protocols, cell lines, genera, and reagents described, as such may vary. It is also to be understood that the terminology used herein is for describing particular embodiments only, and is not intended to limit the scope of the present disclosure.

As used herein the singular forms "a", "and", and "the" include plural referents unless the context clearly dictates otherwise. Thus, for example, reference to "a cell" includes a plurality of such cells and reference to "the protein" includes reference to one or more proteins and equivalents thereof. All technical and scientific terms used herein have the same meaning as commonly understood to one of ordinary skill in the art to which this disclosure belongs unless clearly indicated otherwise.

The present disclosure is drawn to compositions and methods for controlling pests. The methods involve transforming organisms with nucleic acid sequences encoding IPD113 polypeptides. The nucleic acid sequences of the embodiments are useful for preparing plants and microorganisms that possess pesticidal activity. Thus, transformed bacteria, plants, plant cells, plant tissues and seeds are provided. The compositions include pesticidal nucleic acids and proteins of bacterial species. The nucleic acid sequences find use in the construction of expression vectors for subsequent transformation into organisms of interest, as probes for the isolation of other homologous (or partially homologous) genes, and for the generation of altered IPD113 polypeptides by methods, such as site directed mutagenesis, domain swapping or DNA shuffling. The IPD113 polypeptides find use in controlling or killing Lepidopteran, Coleopteran, Dipteran, fungal, Hemipteran and nematode pest populations and for producing compositions with pesticidal activity. Insect pests of interest include, but are not limited to, Lepidoptera species including but not limited to: Corn Earworm, (CEVV) (*Helicoverpa zea*); European Corn Borer (ECB) (*Ostrinia nubialis*), diamond-back moth, e.g., *Helicoverpa zea* Boddie; soybean looper, e.g., *Pseudoplusia includens* Walker; and velvet bean caterpillar e.g., *Anticarsia gemmatalis* Hübner.

By "pesticidal toxin" or "pesticidal protein" or "insecticidal protein" is used herein to refer to a toxin that has toxic activity against one or more pests, including, but not limited to, members of the Lepidoptera, Diptera, Hemiptera and Coleoptera orders or the Nematoda phylum or a protein that has homology to such a protein. Pesticidal proteins have been isolated from organisms including, for example, *Bacillus* sp., *Pseudomonas* sp., *Photorhabdus* sp., *Xenorhabdus* sp., *Clostridium bifermentans* and *Paenibacillus popilliae*. Pesticidal proteins include but are not limited to: insecticidal proteins from *Pseudomonas* sp. such as PSEEN3174 (Monalysin; (2011) PLoS Pathogens 7:1-13); from *Pseudomonas protegens* strain CHA0 and Pf-5 (previously *fluorescens*) (Pechy-Tarr, (2008) Environmental Microbiology 10:2368-2386; GenBank Accession No. EU400157); from *Pseudomonas taiwanensis* (Liu, et al., (2010) J. Agric. Food Chem., 58:12343-12349) and from *Pseudomonas pseudoalcaligenes* (Zhang, et al., (2009) Annals of Microbiology 59:45-50 and Li, et al., (2007) Plant Cell Tiss. Organ Cult. 89:159-168); insecticidal proteins from *Photorhabdus* sp. and *Xenorhabdus* sp. (Hinchliffe, et al., (2010) The Open Toxicology Journal, 3:101-118 and Morgan, et al., (2001) Applied and Envir. Micro. 67:2062-2069); U.S. Pat. Nos. 6,048,838, and 6,379,946; a PIP-1 polypeptide of U.S. Pat. No. 9,688,730; an AfIP-1A and/or AfIP-1B polypeptide of U.S. Pat. No. 9,475,847; a PIP-47 polypeptide of US Publication Number US20160186204; an IPD045 polypeptide, an IPD064 polypeptide, an IPD074 polypeptide, an IPD075 polypeptide, and an IPD077 polypeptide of PCT Publication Number WO 2016/114973; an IPD080 polypeptide of PCT Serial Number PCT/US17/56517; an IPD078 polypeptide, an IPD084 polypeptide, an IPD085 polypeptide, an IPD086 polypeptide, an IPD087 polypeptide, an IPD088 polypeptide, and an IPD089 polypeptide of Serial Number PCT/US17/54160; PIP-72 polypeptide of US Patent Publication Number US20160366891; a PtIP-50 polypeptide and a PtIP-65 polypeptide of US Publication Number US20170166921; an IPD098 polypeptide, an IPD059 polypeptide, an IPD108 polypeptide, an IPD109 polypeptide of U.S. Ser. No. 62/521,084; a PtIP-83 polypeptide of US Publication Number US20160347799; a PtIP-96 polypeptide of US Publication Number US20170233440; an IPD079 polypeptide of PCT Publication Number WO2017/23486; an IPD082 polypeptide of PCT Publication Number WO 2017/105987, an IPD090 polypeptide of Serial Number PCT/US17/30602, an IPD093 polypeptide of U.S. Ser. No. 62/434,020; an IPD103 polypeptide of Serial Number PCT/US17/39376; an IPD101 polypeptide of U.S. Ser. No. 62/438,179; an IPD121 polypeptide of US Serial Number U.S. 62/508,514; and δ-endotoxins including, but not limited to a Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry28, Cry29, Cry30, Cry31, Cry32, Cry33, Cry34, Cry35, Cry36, Cry37, Cry38, Cry39, Cry40, Cry41, Cry42, Cry43, Cry44, Cry45, Cry46, Cry47, Cry49, Cry50, Cry51, Cry52, Cry53, Cry54, Cry55, Cry56, Cry57, Cry58, Cry59, Cry60, Cry61, Cry62, Cry63, Cry64, Cry65, Cry66, Cry67, Cry68, Cry69, Cry70, Cry71, and Cry 72 classes of δ-endotoxin polypeptides and the *B. thuringiensis* cytolytic cyt1 and cyt2 genes. Members of these classes of *B. thuringiensis* insecticidal proteins (see, Crickmore, et al., "*Bacillus thuringiensis* toxin nomenclature" (2011), at life-sci.sussex.ac.uk/home/Neil_Crickmore/Bt/ which can be accessed on the world-wide web using the "www" prefix).

Examples of δ-endotoxins also include but are not limited to Cry1A proteins of U.S. Pat. Nos. 5,880,275, 7,858,849, and 8,878,007; a Cry1Ac mutant of U.S. Pat. No. 9,512,187; a DIG-3 or DIG-11 toxin (N-terminal deletion of α-helix 1 and/or α-helix 2 variants of cry proteins such as Cry1A, Cry3A) of U.S. Pat. Nos. 8,304,604, 8,304,605 and 8,476, 226; Cry1B of U.S. patent application Ser. No. 10/525,318, US Patent Application Publication Number US20160194364, and U.S. Pat. Nos. 9,404,121 and 8,772, 577; Cry1B variants of PCT Publication Number WO2016/61197 and Serial Number PCT/US17/27160; Cry1C of U.S. Pat. No. 6,033,874; Cry1D protein of US20170233759; a Cry1E protein of PCT Serial Number PCT/US17/53178; a Cry1F protein of U.S. Pat. Nos. 5,188,960 and 6,218,188; Cry1A/F chimeras of U.S. Pat. Nos. 7,070,982; 6,962,705 and 6,713,063; a Cry1I protein of PCT Publication number WO 2017/0233759; a Cry1J variant of US Publication US20170240603; a Cry2 protein such as Cry2Ab protein of U.S. Pat. No. 7,064,249 and Cry2A.127 protein of U.S. Pat. No. 7,208,474; a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476, 781, 7,105,332, 7,339,092, 7,378,499, 7,462,760, and 9,593, 345; a Cry9 protein such as such as members of the Cry9A, Cry9B, Cry9C, Cry9D, Cry9E and Cry9F families including the Cry9 protein of U.S. Pat. Nos. 9,000,261 and 8,802,933, and US Serial Number WO 2017/132188; a Cry15 protein of Naimov, et al., (2008) Applied and Environmental Microbiology, 74:7145-7151; a Cry14 protein of U.S. Pat. No. 8,933,299; a Cry22, a Cry34Ab1 protein of U.S. Pat. Nos. 6,127,180, 6,624,145 and 6,340,593; a truncated Cry34 protein of U.S. Pat. No. 8,816,157; a CryET33 and cryET34 protein of U.S. Pat. Nos. 6,248,535, 6,326,351, 6,399,330, 6,949,626, 7,385,107 and 7,504,229; a CryET33 and CryET34 homologs of US Patent Publication Number 2006/0191034, 2012/0278954, and PCT Publication Number WO 2012/139004; a Cry35Ab1 protein of U.S. Pat. Nos. 6,083, 499, 6,548,291 and 6,340,593; a Cry46 protein of U.S. Pat. No. 9,403,881, a Cry 51 protein, a Cry binary toxin; a TIC901 or related toxin; TIC807 of US Patent Application Publication Number 2008/0295207; TIC853 of U.S. Pat. No. 8,513,493; ET29, ET37, TIC809, TIC810, TIC812, TIC127, TIC128 of PCT US 2006/033867; engineered Hemipteran toxic proteins of US Patent Application Publication Number US20160150795, AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020 and AXMI-021 of WO 2006/083891; AXMI-010 of WO 2005/038032; AXMI-003 of WO 2005/021585; AXMI-008 of US Patent Application Publication Number 2004/0250311; AXMI-006 of US Patent Application Publication Number 2004/0216186; AXMI-007 of US Patent Application Publication Number 2004/0210965; AXMI-009 of US Patent Application Number 2004/0210964; AXMI-014 of US Patent Application Publication Number 2004/0197917; AXMI-004 of US Patent Application Publication Number 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US Patent Application Publication Number 2011/0023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063 and AXMI-064 of US Patent Application Publication Number 2011/0263488; AXMI046, AXMI048, AXMI050, AXMI051, AXMI052, AXMI053, AXMI054, AXMI055, AXMI056, AXMI057, AXMI058, AXMI059, AXMI060, AXMI061, AXMI067, AXMI069, AXMI071, AXMI072, AXMI073, AXMI074, AXMI075, AXMI087, AXMI088, AXMI093, AXMI070, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI125, AXMI126, AXMI127, AXMI129, AXMI151, AXMI161, AXMI164, AXMI183, AXMI132, AXMI137, AXMI138 of U.S. Pat. Nos. 8,461,421 and 8,461,422; AXMI-R1 and related proteins of US Patent Application Publication Number 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230 and AXMI231 of WO 2011/103247; AXMI-115, AXMI-113, AXMI-005, AXMI-163 and AXMI-184 of U.S. Pat. No. 8,334,431; AXMI-001, AXMI-002, AXMI-030, AXMI-035 and AXMI-045 of US Patent Application Publication Number 2010/0298211; AXMI-066 and AXMI-076 of US Patent Application Publication Number 2009/0144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, dsAXMI111, AXMI112, AXMI114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of U.S. Pat. No. 8,461,421; AXMI192 of U.S. Pat. No. 8,461,415; AXMI281 of US Patent Application Publication Number US20160177332; AXMI422 of U.S. Pat. No. 8,252,872; cry proteins such as Cry1A and Cry3A having modified proteolytic sites of U.S. Pat. No. 8,319,019; a Cry1Ac, Cry2Aa and Cry1Ca toxin protein from *Bacillus thuringiensis* strain VBTS 2528 of US Patent Application Publication Number 2011/0064710. The Cry proteins MP032, MP049, MP051, MP066, MP068, MP070, MP091S, MP109S, MP114, MP121, MP134S, MP183S, MP185S, MP186S, MP195S, MP197S, MP208S, MP209S, MP212S, MP214S, MP217S, MP222S, MP234S, MP235S, MP237S, MP242S, MP243, MP248, MP249S, MP251M, MP252S, MP253, MP259S, MP287S, MP288S, MP295S, MP296S, MP297S, MP300S, MP304S, MP306S, MP310S, MP312S, MP314S, MP319S, MP325S, MP326S, MP327S, MP328S, MP334S, MP337S, MP342S, MP349S, MP356S, MP359S, MP360S, MP437S, MP451S, MP452S, MP466S, MP468S, MP476S, MP482S, MP522S, MP529S, MP548S, MP552S, MP562S, MP564S, MP566S, MP567S, MP569S, MP573S, MP574S, MP575S, MP581S, MP590, MP594S, MP596S, MP597, MP599S, MP600S, MP601S, MP602S, MP604S, MP626S, MP629S, MP630S, MP631S, MP632S, MP633S, MP634S, MP635S, MP639S, MP640S, MP644S, MP649S, MP651S, MP652S, MP653S, MP661S, MP666S, MP672S, MP696S, MP704S, MP724S, MP729S, MP739S, MP755S, MP773S, MP799S, MP800S, MP801S, MP802S, MP803S, MP805S, MP809S, MP815S, MP828S, MP831S, MP844S, MP852, MP865S, MP879S, MP887S, MP891S, MP896S, MP898S, MP935S, MP968, MP989, MP993, MP997, MP1049, MP1066, MP1067, MP1080, MP1081, MP1200, MP1206, MP1233, and MP1311 of U.S. Ser. No. 62/607,372. The insecticidal activity of Cry proteins is well known to one skilled in the art (for review, see, van Frannkenhuyzen, (2009) J. Invert. Path. 101:1-16). The use of Cry proteins as transgenic plant traits and Cry-transgenic plants including but not limited to plants expressing Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) Plant Biotech Journal 9:283-300 and the CERA. (2010) GM Crop Database Center for Environmental Risk Assessment (CERA), ILSI Research Foundation, Washington D.C. at cera-gmc.org/index.php?action=gm_crop_database which can be accessed on the world-wide web using the "www" prefix). More than one pesticidal proteins can also be expressed in plants such as Vip3Ab & Cry1Fa (US2012/0317682); Cry1BE & Cry1F (US2012/0311746); Cry1CA & Cry1AB (US2012/0311745); Cry1F & CryCa (US2012/0317681); Cry1DA & Cry1BE (US2012/0331590); Cry1DA & Cry1Fa (US2012/0331589); Cry1AB & Cry1BE (US2012/0324606); Cry1Fa & Cry2Aa and Cry1I & Cry1E (US2012/0324605); Cry34Ab/35Ab & Cry6Aa (US20130167269); Cry34Ab/VCry35Ab & Cry3Aa (US20130167268); Cry1Da & Cry1Ca (U.S. Pat. No. 9,796,982); Cry3Aa & Cry6Aa (U.S. Pat. No. 9,798,963); and Cry3A & Cry1Ab or Vip3Aa (U.S. Pat. No. 9,045,766). Pesticidal proteins also include insecticidal lipases including lipid acyl hydrolases of U.S. Pat. No. 7,491,869, and cholesterol oxidases such as from *Streptomyces* (Purcell et al. (1993) Biochem Biophys Res Commun 15:1406-1413). Pesticidal proteins also include VIP (vegetative insecticidal proteins) toxins of U.S. Pat. Nos. 5,877,012, 6,107,279 6,137,033, 7,244,820, 7,615,686, and 8,237,020 and the like. Other VIP proteins (see, lifesci.sussex.ac.uk/home/Neil_Crickmore/Bt/vip.html) which can be accessed on the world-wide web using the "www" prefix). Pesticidal proteins also include Cyt proteins including Cyt1A variants of PCT Serial Number PCT/US2017/000510; Pesticidal proteins also include toxin complex (TC) proteins, obtainable from organisms such as *Xenorhabdus*, *Photorhabdus* and *Paenibacillus* (see, U.S. Pat. Nos. 7,491, 698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus*, *Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but not limited to lycotoxin-1 peptides and mutants thereof (U.S. Pat. No. 8,334,366). The combinations generated can also include multiple copies of any one of the polynucleotides of interest.

In some embodiments, the IPD113 polypeptide includes an amino acid sequence deduced from the full-length nucleic acid sequence disclosed herein and amino acid sequences that are shorter than the full-length sequences, either due to the use of an alternate downstream start site or due to processing that produces a shorter protein having pesticidal activity. Processing may occur in the organism the protein is expressed in or in the pest after ingestion of the protein.

Thus, provided herein are novel isolated or recombinant nucleic acid sequences that confer pesticidal activity. Also provided are the amino acid sequences of IPD113 polypeptides. The protein resulting from translation of these IPD113 genes allows cells to control or kill certain pests that ingest it.

IPD113 Proteins and Variants and Fragments Thereof

IPD113 polypeptides are encompassed by the disclosure. "IPD113 polypeptide" and "IPD113 protein" as used herein interchangeably refers to a polypeptide having insecticidal activity including but not limited to insecticidal activity against one or more insect pests of the Lepidoptera order, and is sufficiently homologous to the IPD113Dh polypeptide of SEQ ID NO: 16. A variety of IPD113 polypeptides are contemplated. Sources of IPD113 polypeptides or related proteins include fern or other primitive plant species selected from, but not limited to, the Genus *Pteris, Polypodium, Nephrolepis, Colysis, Tectaria, Davallia, Polystichum, Adiantum, Asplenium, Blechnum, Lygodium, Ophioglossum, Pyrrosia, Doryopteris, Dryopteris, Pellaea, Gymnocarpium, Cheilanthes, Pteridium, Christella, Lastreopsis, Campyloneurum, Hemionitis, Selliguea*, and *Arachniodes*.

In some embodiments, the IPD113 polypeptide is derived from a species in the Genus *Pteris*. In some embodiments, the IPD113 polypeptide is derived from a *Pteris* species selected from but not limited to *Pteris aberrans, Pteris abyssinica, Pteris actiniopteroides, Pteris adscensionis, Pteris albersii, Pteris albertiae, Pteris altissima, Pteris amoena, Pteris angustata, Pteris angustipinna, Pteris angustipinnula, Pteris appendiculifera, Pteris arborea, Pteris argyraea, Pteris aspericaulis, Pteris asperula, Pteris atrovirens, Pteris auquieri, Pteris austrosinica, Pteris bahamensis, Pteris bakeri, Pteris baksaensis, Pteris balansae, Pteris bambusoides, Pteris barbigera, Pteris barombiensis, Pteris bavazzanoi, Pteris beecheyana, Pteris bella, Pteris* berteroana, *Pteris biaurita*, *Pteris biformis*, *Pteris blanchetiana*, *Pteris blumeana*, *Pteris boninensis*, *Pteris brassii*, *Pteris brevis*, *Pteris brooksiana*, *Pteris buchananii*, *Pteris buchtienii*, *Pteris burtonii*, *Pteris cadieri*, *Pteris caesia*, *Pteris caiyangheensis*, *Pteris calcarea*, *Pteris calocarpa*, *Pteris catoptera*, *Pteris chiapensis*, *Pteris chilensis*, *Pteris christensenii*, *Pteris chrysodioides*, *Pteris ciliaris*, *Pteris clemensiae*, *Pteris comans*, *Pteris commutata*, *Pteris concinna*, *Pteris confertinervia*, *Pteris confusa*, *Pteris congesta*, *Pteris consanguinea*, *Pteris coriacea*, *Pteris crassiuscula*, *Pteris cretica*, *Pteris croesus*, *Pteris cryptogrammoides*, *Pteris cuminglii*, *Pteris dactylina*, *Pteris daguensis*, *Pteris dalhousiae*, *Pteris dataensis*, *Pteris dayakorum*, *Pteris decrescens*, *Pteris decurrens*, *Pteris deflexa*, *Pteris deltea*, *Pteris deltodon*, *Pteris deltoidea*, *Pteris dentata*, *Pteris denticulata*, *Pteris dispar*, *Pteris dissimilis*, *Pteris dissitifolia*, *Pteris distans*, *Pteris droogmaniana*, *Pteris edanyoi*, *Pteris ekmanii*, *Pteris elmeri*, *Pteris elongatiloba*, *Pteris endoneura*, *Pteris ensiformis*, *Pteris esquirofii*, *Pteris excelsa*, *Pteris famatinensis*, *Pteris fauriei*, *Pteris finotii*, *Pteris flava*, *Pteris formosana*, *Pteris fraseri*, *Pteris friesii* *Pteris gallinopes*, *Pteris geminata*, *Pteris gigantea*, *Pteris glaucovirens*, *Pteris goeldii*, *Pteris gongalensis*, *Pteris grandifolia*, *Pteris grevilleana*, *Pteris griffithii*, *Pteris griseoviridis*, *Pteris guangdongensis*, *Pteris guizhouensis*, *Pteris haenkeana*, *Pteris hamulosa*, *Pteris hartiana*, *Pteris heteroclita*, *Pteris heteromorpha*, *Pteris heterophlebia*, *Pteris hillebrandii*, *Pteris hirsutissima*, *Pteris hirtula*, *Pteris hispaniolica*, *Pteris holttumii*, *Pteris hondurensis*, *Pteris hookeriana*, *Pteris hossei*, *Pteris hostmanniana*, *Pteris hui*, *Pteris humberfii*, *Pteris hunanensis*, *Pteris inaequalis*, *Pteris incompleta*, *Pteris inermis*, *Pteris insigni*, *Pteris intricata*, *Pteris intromissa*, *Pteris irregularis*, *Pteris iuzonensis*, *Pteris izuensis*, *Pteris johannis-winkleri*, *Pteris junghuhnii*, *Pteris kawabatae*, *Pteris keysseri*, *Pteris khasiana*, *Pteris kidoi*, *Pteris kinabaluensis*, *Pteris kingiana*, *Pteris kiuschiuensis*, *Pteris laevis*, *Pteris lanceifolia*, *Pteris lastii*, *Pteris laurea*, *Pteris laurisilvicola*, *Pteris lechleri*, *Pteris lepidopoda*, *Pteris leptophylla*, *Pteris liboensis*, *Pteris ligulata*, *Pteris limae*, *Pteris linearis*, *Pteris litoralis*, *Pteris livida*, *Pteris loheri*, *Pteris longifolia*, *Pteris longipes*, *Pteris longipetiolulata*, *Pteris longipinna*, *Pteris longipinnula*, *Pteris luederwaldtii*, *Pteris luschnathiana*, *Pteris luzonensis*, *Pteris lydgatei*, *Pteris macgregorii*, *Pteris macilenta*, *Pteris maclurei*, *Pteris maclurioides*, *Pteris macracantha*, *Pteris macrodon*, *Pteris macrophylla*, *Pteris macroptera*, *Pteris madagascarica*, *Pteris majestica*, *Pteris malipoensis*, *Pteris manniana*, *Pteris melanocaulon*, *Pteris melanorhachis*, *Pteris menglaensis*, *Pteris mertensioides*, *Pteris mettenii*, *Pteris micracantha*, *Pteris microdictyon*, *Pteris microlepis*, *Pteris microptera*, *Pteris mildbraedii*, *Pteris moluccana*, *Pteris monghaiensis*, *Pteris montis-wilhelminae*, *Pteris morii*, *Pteris mucronulata*, *Pteris multiaurita*, *Pteris multifida*, *Pteris muricata*, *Pteris muricatopedata*, *Pteris muricella*, *Pteris mutilata*, *Pteris natiensis*, *Pteris navarrensis*, *Pteris nipponica*, *Pteris novae-caledoniae*, *Pteris obtusiloba*, *Pteris occidentalisinica*, *Pteris olivacea*, *Pteris opaca*, *Pteris oppositipinnata*, *Pteris orientalis*, *Pteris orizabae*, *Pteris oshimensis*, *Pteris otaria*, *Pteris pachysora*, *Pteris pacifica*, *Pteris paleacea*, *Pteris papuana*, *Pteris parhamii*, *Pteris paucinervata*, *Pteris paucipinnata*, *Pteris paulistana*, *Pteris pearcei*, *Pteris pedicellata*, *Pteris pediformis*, *Pteris pellucida*, *Pteris perrieriana*, *Pteris perrottetii*, *Pteris philippinensis*, *Pteris phuluangensis*, *Pteris pilosiuscula*, *Pteris plumbea*, *Pteris pluricaudata*, *Pteris podophylla*, *Pteris polita*, *Pteris polyphylla*, *Pteris porphyrophlebia*, *Pteris praetermissa*, *Pteris preussii*, *Pteris prolifera*, *Pteris propinqua*, *Pteris pseudolonchitis*, *Pteris pseudopellucida*, *Pteris pteridioides*, *Pteris puberula*, *Pteris pulchra*, *Pteris pungens*, *Pteris purdoniana*, *Pteris purpureorachis*, *Pteris quadriaurita*, *Pteris quinquefoliata*, *Pteris quinquepartita*, *Pteris radicans*, *Pteris ramosii*, *Pteris rangiferina*, *Pteris reducta*, *Pteris remotifolia*, *Pteris reptans*, *Pteris rigidula*, *Pteris rosenstockii*, *Pteris roseo-lilacina*, *Pteris ryukyuensis*, *Pteris satsumana*, *Pteris saxatilis*, *Pteris scabra*, *Pteris scabripes*, *Pteris schlechteri*, *Pteris schwackeana*, *Pteris semiadnata*, *Pteris semipinnata*, *Pteris sericea*, *Pteris setigera*, *Pteris setuloso-costulata*, *Pteris shimenensis*, *Pteris shimianensis*, *Pteris silvatica*, *Pteris similis*, *Pteris simplex*, *Pteris sintenensis*, *Pteris speciosa*, *Pteris splendens*, *Pteris splendida*, *Pteris squamaestipes*, *Pteris squamipes*, *Pteris stenophylla*, *Pteris stridens*, *Pteris striphnophylla*, *Pteris subindivisa*, *Pteris subquinata*, *Pteris subsimplex*, *Pteris sumatrana*, *Pteris swartziana*, *Pteris taiwanensis*, *Pteris talamauana*, *Pteris tapeinidiifolia*, *Pteris tarandus*, *Pteris tenuissima*, *Pteris togoensis*, *Pteris torricelliana*, *Pteris trachyrachis*, *Pteris transparens*, *Pteris tremula*, *Pteris treubii*, *Pteris tricolor*, *Pteris tripartita*, *Pteris tussaci*, *Pteris umbrosa*, *Pteris undulatipinna*, *Pteris usambarensis*, *Pteris vaupelii*, *Pteris venusta*, *Pteris verticillata*, *Pteris vieillardii*, *Pteris viridissima*, *Pteris vitiensis*, *Pteris vittata*, *Pteris wallichiana*, *Pteris wangiana*, *Pteris warburgii*, *Pteris wemeri*, *Pteris whitfordii*, *Pteris woodwardioides*, *Pteris wulaiensis*, *Pteris yakuinsularis*, *Pteris yamatensis*, *Pteris zahlbruckneriana*, and *Pteris zippelii*.

In some embodiments, the IPD113 polypeptide is derived from a fern species in the Order Polypodiales, Family Polypodiaceae, Genus *Polypodium* L. In some embodiments, the IPD113 polypeptide is derived from a fern species in the Order Polypodiales, Family Polypodiaceae, Genus *Polypodium* L. selected from, but not limited to, *Polypodium absidatum*, *Polypodium acutifolium*, *Polypodium adiantiforme*, *Polypodium aequale*, *Polypodium affine*, *Polypodium albidopaleatum*, *Polypodium alcicorne*, *Polypodium alfarii*, *Polypodium alfredii*, *Polypodium alfredii* var. *curtii*, *Polypodium allosuroides*, *Polypodium alsophilicola*, *Polypodium amamianum*, *Polypodium amoenum*, *Polypodium amorphum*, *Polypodium anetioides*, *Polypodium anfractuosum*, *Polypodium anguinum*, *Polypodium angustifolium* f. *remotifolia*, *Polypodium angustifolium* var. *amphostenon*, *Polypodium angustifolium* var. *heterolepis*, *Polypodium angustifolium* var. *monstrosa*, *Polypodium angustipaleatum*, *Polypodium angustissimum*, *Polypodium anisomeron* var. *pectinatum*, *Polypodium antioquianum*, *Polypodium aoristisorum*, *Polypodium apagolepis*, *Polypodium apicidens*, *Polypodium apiculatum*, *Polypodium apoense*, *Polypodium appalachianum*, *Polypodium appressum*, *Polypodium arenarium*, *Polypodium argentinum*, *Polypodium argutum*, *Polypodium armatum*, *Polypodium aromaticum*, *Polypodium aspersum*, *Polypodium assurgens*, *Polypodium atrum*, *Polypodium auriculatum*, *Polypodium balaonense*, *Polypodium balliviani*, *Polypodium bamleri*, *Polypodium bangii*, *Polypodium bartlettii*, *Polypodium basale*, *Polypodium bemoullii*, *Polypodium biauritum*, *Polypodium bifrons*, *Polypodium blepharodes*, *Polypodium bolivari*, *Polypodium bolivianum*, *Polypodium bolobense*, *Polypodium bombycinum*, *Polypodium bombycinum* var. *insularum*, *Polypodium bradeorum*, *Polypodium bryophilum*, *Polypodium bryopodum*, *Polypodium buchtienii*, *Polypodium buesii*, *Polypodium bulbotrichum*, *Polypodium caceresii*, *Polypodium californicum* f. *brauscombii*, *Polypodium californicum* f. *parsonsiae*, *Polypodium californicum*, *Polypodium calophlebium*, *Polypodium calvum*, *Polypodium camptophyllarium* var. *abbreviatum*, *Polypodium capitellatum*,

*Polypodium carpinterae, Polypodium chachapoyense, Polypodium chartaceum, Polypodium chimantense, Polypodium chiricanum, Polypodium choquetangense, Polypodium christensenii, Polypodium christii, Polypodium chrysotrichum, Polypodium ciliolepis, Polypodium cinerascens, Polypodium collinsii, Polypodium colysoides, Polypodium confluens, Polypodium conforme, Polypodium confusum, Polypodium congregatifolium, Polypodium connellii, Polypodium consimile* var. *bourgaeanum, Polypodium consimile* var. *minor, Polypodium conterminans, Polypodium contiguum, Polypodium cookii, Polypodium coriaceum, Polypodium coronans, Polypodium costaricense, Polypodium costatum, Polypodium crassifolium* f. *angustissimum, Polypodium crassifolium* var. *longipes, Polypodium crassulum, Polypodium craterisorum, Polypodium cryptum, Polypodium crystalloneuron, Polypodium cucullatum* var. *planum, Polypodium cuencanum, Polypodium cumingianum, Polypodium cupreolepis, Polypodium curranii, Polypodium curvans, Polypodium cyathicola, Polypodium cyathisorum, Polypodium cyclocolpon, Polypodium daguense, Polypodium damunense, Polypodium dareiformioides, Polypodium dasypleura, Polypodium decipiens, Polypodium decorum, Polypodium delicatulum, Polypodium deltoideum, Polypodium demeraranum, Polypodium denticulatum, Polypodium diaphanum, Polypodium dilatatum, Polypodium dispersum, Polypodium dissectum, Polypodium dissimulans, Polypodium dolichosorum, Polypodium dolorense, Polypodium donnell-smithii, Polypodium drymoglossoides, Polypodium ebeninum, Polypodium eggersii, Polypodium elmeri, Polypodium elongatum, Polypodium enterosoroides, Polypodium erubescens, Polypodium erythrolepis, Polypodium erythrotrichum, Polypodium eurybasis, Polypodium eurybasis* var. *villosum, Polypodium exornans, Polypodium falcoideum, Polypodium fallacissimum, Polypodium farinosum, Polypodium faucium, Polypodium feei, Polypodium ferrugineum, Polypodium feuillei, Polypodium firmulum, Polypodium firmum, Polypodium flaccidum, Polypodium flagellare, Polypodium flexuosum, Polypodium flexuosum* var. *ekmanii, Polypodium forbesii, Polypodium formosanum, Polypodium fraxinifolium* subsp. *articulatum, Polypodium fraxinifolium* subsp. *luridum, Polypodium fructuosum, Polypodium fucoides, Polypodium fulvescens, Polypodium galeottii, Polypodium glaucum, Polypodium glycyrrhiza, Polypodium gracillimum, Polypodium gramineum, Polypodium grandifolium, Polypodium gratum, Polypodium graveolens, Polypodium griseo-nigrum, Polypodium griseum, Polypodium guttatum, Polypodium haalilioanum, Polypodium hammatisorum, Polypodium hancockii, Polypodium haplophlebicum, Polypodium harrisii, Polypodium hastatum* var. *simplex, Polypodium hawaiiense, Polypodium heanophyllum, Polypodium helleri, Polypodium hemionitidium, Polypodium henryi, Polypodium herzogii, Polypodium hesperium, Polypodium hessii, Polypodium hombersleyi, Polypodium hostmannii, Polypodium humile, Polypodium hyalinum, Polypodium iboense, Polypodium induens* var. *subdentatum, Polypodium insidiosum, Polypodium insigne, Polypodium intermedium* subsp. *masafueranum* var. *obtuseserratum, Polypodium intramarginale, Polypodium involutum, Polypodium itatiayense, Polypodium javanicum, Polypodium juglandifolium, Polypodium kaniense, Polypodium knowltoniorum, Polypodium kyimbilense, Polypodium l'herminieri* var. *costaricense, Polypodium lachniferum* f. *incurvata, Polypodium lachniferum* var. *glabrescens, Polypodium lachnopus, Polypodium lanceolatum* var. *complanatum, Polypodium lanceolatum* var. *trichophorum, Polypodium latevagans, Polypodium laxifrons, Polypodium laxifrons* var. *lividum, Polypodium lehmannianum, Polypodium leiorhizum, Polypodium leptopodon, Polypodium leuconeuron* var. *angustifolia, Polypodium leuconeuron* var. *latifolium, Polypodium leucosticta, Polypodium limulum, Polypodium lindigii, Polypodium lineatum, Polypodium lomarioides, Polypodium longifrons, Polypodium loretense, Polypodium loriceum* var. *umbraticum, Polypodium loriforme, Polypodium loxogramme* f. *gigas, Polypodium ludens, Polypodium luzonicum, Polypodium lycopodioides* f. *obtusum, Polypodium lycopodioides* L., *Polypodium macrolepis, Polypodium macrophyllum, Polypodium macrosorum, Polypodium macrosphaerum, Polypodium maculosum, Polypodium madrense, Polypodium manmeiense, Polypodium margaritiferum, Polypodium maritimum, Polypodium martensii, Polypodium mayoris, Polypodium megalolepis, Polypodium melanotrichum, Polypodium menisciifolium* var. *pubescens, Polypodium meniscioides, Polypodium merrillii, Polypodium mettenii, Polypodium mexiae, Polypodium microsorum, Polypodium militare, Polypodium minimum, Polypodium minusculum, Polypodium mixtum, Polypodium mollendense, Polypodium mollissimum, Polypodium moniliforme* var. *minus, Polypodium monoides, Polypodium monticola, Polypodium montigenum, Polypodium moritzianum, Polypodium moultonii, Polypodium multicaudatum, Polypodium multilineatum, Polypodium multisorum, Polypodium munchii, Polypodium muscoides, Polypodium myriolepis, Polypodium myriophyllum, Polypodium myriotrichum, Polypodium nematorhizon, Polypodium nemorale, Polypodium nesioticum, Polypodium nigrescentium, Polypodium nigripes, Polypodium nigrocinctum, Polypodium nimbatum, Polypodium nitidissimum, Polypodium nitidissimum* var. *latior, Polypodium nubrigenum, Polypodium oligolepis, Polypodium oligosorum, Polypodium oligosorum, Polypodium olivaceum, Polypodium olivaceum* var. *elatum, Polypodium oodes, Polypodium oosphaerum, Polypodium oreophilum, Polypodium ornatissimum, Polypodium ornatum, Polypodium ovatum, Polypodium oxylobum, Polypodium oxypholis, Polypodium pakkaense, Polypodium pallidum, Polypodium palmatopedatum, Polypodium palmeri, Polypodium panamense, Polypodium parvum, Polypodium patagonicum, Polypodium paucisorum, Polypodium pavonianum, Polypodium pectinatum* var. *caliense, Polypodium pectinatum* var. *hispidum, Polypodium pellucidum, Polypodium pendulum* var. *boliviense, Polypodium percrassum, Polypodium perpusillum, Polypodium peruvianum* var. *subgibbosum, Polypodium phyllitidis* var. *elongatum, Polypodium pichinchense, Polypodium pilosissimum, Polypodium pilosissimum* var. *glabriusculum, Polypodium pilossimum* var. *tunguraquensis, Polypodium pityrolepis, Polypodium platyphyllum, Polypodium playfairii, Polypodium plebeium* var. *cooperi, Polypodium plectolepidioides, Polypodium pleolepis, Polypodium plesiosorum* var. *i, Polypodium podobasis, Polypodium podocarpum, Polypodium poloense, Polypodium polydatylon, Polypodium polypodioides* var. *aciculare, Polypodium polypodioides* var. *michauxianum, Polypodium praetermissum, Polypodium preslianum* var. *immersum, Polypodium procerum, Polypodium procerum, Polypodium productum, Polypodium productum, Polypodium prolongilobum, Polypodium propinguum, Polypodium proteus, Polypodium pruinatum, Polypodium pseudocapillare, Polypodium pseudofratemum, Polypodium pseudonutans, Polypodium pseudoserratum, Polypodium pulcherrimum, Polypodium pulogense, Polypodium pungens, Polypodium purpusii, Polypodium radicale, Polypodium randallii, Polypodium ratiborii, Polypodium reclinatum, Polypodium recreense, Polypodium repens* var. *abruptum, Polypodium revolvens, Polypodium rhachipterygium, Polypodium rhomboideum,*

*Polypodium rigens, Polypodium robustum, Polypodium roraimense, Polypodium roraimense, Polypodium rosei, Polypodium rosenstockii, Polypodium rubidum, Polypodium rudimentum, Polypodium rusbyi, Polypodium sablanianum, Polypodium sarmentosum, Polypodium saxicola, Polypodium schenckii, Polypodium schlechteri, Polypodium scolopendria, Polypodium scolopendria, Polypodium scolopendrium, Polypodium scouleri, Polypodium scutulatum, Polypodium segregatum, Polypodium semihirsutum, Polypodium semihirsutum* var. *fuscosetosum, Polypodium senile* var. *minor, Polypodium sericeolanatum, Polypodium serraeforme, Polypodium serricula, Polypodium sesquipedala, Polypodium sessilifolium, Polypodium setosum* var. *calvum, Polypodium setulosum, Polypodium shaferi, Polypodium sibomense, Polypodium siccum, Polypodium simacense, Polypodium simulans, Polypodium singeri, Polypodium sinicum, Polypodium sintenisii, Polypodium skutchii, Polypodium sloanei, Polypodium sodiroi, Polypodium sordidulum, Polypodium sordidum, Polypodium sphaeropteroides, Polypodium sphenodes, Polypodium sprucei, Polypodium sprucei* var. *furcativenosa, Polypodium steirolepis, Polypodium stenobasis, Polypodium stenolepis, Polypodium stenopterum, Polypodium subcapillare, Polypodium subflabelliforme, Polypodium subhemionitidium, Polypodium subinaequale, Polypodium subintegrum, Polypodium subspathulatum, Polypodium subtile, Polypodium subvestitum, Polypodium subviride, Polypodium superficiale* var. *attenuatum, Polypodium superficiale* var. *chinensis, Polypodium sursumcurrens, Polypodium tablazianum, Polypodium taenifolium, Polypodium tamandarei, Polypodium tatei, Polypodium tenuiculum* var. *acrosora, Polypodium tenuiculum* var. *brasiliense, Polypodium tenuilore, Polypodium tenuinerve, Polypodium tepuiense, Polypodium teresae, Polypodium tetragonum* var. *incompletum, Polypodium thysanolepis* var. *bipinnatifidum, Polypodium thyssanolepis,* var. *thyssanolepis, Polypodium thyssanolepsi, Polypodium tobagense, Polypodium trichophyllum, Polypodium tridactylum, Polypodium tridentatum, Polypodium trifurcatum* var. *brevipes, Polypodium triglossum, Polypodium truncatulum, Polypodium truncicola* var. *major, Polypodium truncicola* var. *minor, Polypodium tuberosum, Polypodium tunguraguae, Polypodium turquinum, Polypodium turrialbae, Polypodium ursipes, Polypodium vagans, Polypodium valdealatum, Polypodium versteegii, Polypodium villagranii, Polypodium virginianum* f. *cambroideum, Polypodium virginianum* f. *peraferens, Polypodium vittarioides, Polypodium vulgare, Polypodium vulgare* L., *Polypodium vulgare* subsp. *oreophilum, Polypodium vulgare* var. *acuminatum, Polypodium vulpinum, Polypodium williamsii, Polypodium wobbense, Polypodium×fallacissimum-guttatum, Polypodium xantholepis, Polypodium xiphopteris, Polypodium yarumalense, Polypodium yungense,* and *Polypodium zosteriforme.*

In some embodiments, the IPD113 polypeptide is derived from a fern species in the Order Polypodiales.

In some embodiments, the IPD113 polypeptide is derived from a fern species in the Order Polypodiales, Family Nephrolepidaceae.

In some embodiments, the IPD113 polypeptide is derived from a fern species in the Order Polypodiales, Family Nephrolepidaceae, Genus *Nephrolepis* selected from, but not limited to, *Nephrolepis abrupta, Nephrolepis acutifolia, Nephrolepis averyi, Nephrolepis biserrata, Nephrolepis brownii, Nephrolepis copelandi, Nephrolepis cordifolia, Nephrolepis davalliae, Nephrolepis davallioides, Nephrolepis dicksonioides, Nephrolepis exaltata, Nephrolepis falcata, Nephrolepis falciformis, Nephrolepis hippocrepicis, Nephrolepis laurifolia, Nephrolepis lauterbachii, Nephrolepis medlerae, Nephrolepis obliterata, Nephrolepis pectinata, Nephrolepis pendula, Nephrolepis pseudobiserrata, Nephrolepis radicans, Nephrolepis rivularis,* and *Nephrolepis undulata.*

In some embodiments, the IPD113 polypeptide is derived from a fern species in the order Polypodiales, Family Polypodiaceae, Genus *Colysis* selected from, but not limited to, *Colysis ampla, Colysis digitata, Colysis diversifolia, Colysis elegans Colysis elliptica, Colysis flexiloba, Colysis hemionitidea, Colysis hemitoma, Colysis henryi, Colysis insignis, Colysis intermedia, Colysis leveillei, Colysis longipes, Colysis pedunculata, Colysis pentaphylla, Colysis pothifolia, Colysis pteropus, Colysis shintenensis, Colysis simplicifrons, Colysis triphylla, Colysis wrightii,* and *Colysis×shintenensis.*

In some embodiments, the IPD113 polypeptide is derived from a fern species in the Order Polypodiales, Family Tectariaceae.

In some embodiments, the IPD113 polypeptide is derived from a fern species in the Order Polypodiales, Family Tectariaceae, Genus *Tectaria* selected from, but not limited to, *Tectaria acerifolia, Tectaria acrocarpa, Tectaria adenophora, Tectaria aequatoriensis, Tectaria amblyotis, Tectaria amphiblestra, Tectaria andersonii, Tectaria angelicifolia, Tectaria angulata, Tectaria antioquiana, Tectaria athyrioides, Tectaria athyriosora, Tectaria aurita, Tectaria balansae, Tectaria barberi, Tectaria barteri, Tectaria beccariana, Tectaria blumeana, Tectaria brachiata, Tectaria brauniana, Tectaria brevilobata, Tectaria brooksii, Tectaria buchtienii, Tectaria calcarea, Tectaria camerooniana, Tectaria chattagramica, Tectaria cherasica, Tectaria chimborazensis, Tectaria chinensis, Tectaria christii, Tectaria christovalensis, Tectaria cicutaria, Tectaria coadunata, Tectaria confluens, Tectaria consimilis, Tectaria cordulata, Tectaria coriandrifolia, Tectaria craspedocarpa, Tectaria crenata, Tectaria crinigera, Tectaria croftii, Tectaria curtisii, Tectaria danfuensis, Tectaria decalyana, Tectaria decastroi, Tectaria decurrens, Tectaria degeneri, Tectaria dolichosora, Tectaria draconoptera, Tectaria dubia, Tectaria durvillei, Tectaria ebenina, Tectaria estremerana, Tectaria exauriculata, Tectaria fauriei, Tectaria fengii Tectaria fernandensis, Tectaria ferruginea, Tectaria filisquamata, Tectaria fimbriata, Tectaria fissa, Tectaria gaudichaudii, Tectaria gemmifera, Tectaria godeffroyi, Tectaria grandidentata, Tectaria griffithii* var. *singaporeana, Tectaria grossedentata, Tectaria hederifolia, Tectaria hekouensis, Tectaria heracleifolia, Tectaria herpetocaulos, Tectaria heterocarpa, Tectaria hilocarpa, Tectaria holttumii, Tectaria hookeri, Tectaria humbertiana, Tectaria hymenodes, Tectaria hymenophylla, Tectaria impressa, Tectaria incisa, Tectaria inopinata, Tectaria isomorpha, Tectaria jacobsii, Tectaria jardini, Tectaria johannis-winkleri, Tectaria keckii, Tectaria kehdingiana, Tectaria kingii, Tectaria kouniensis, Tectaria kweichowensis, Tectaria labrusca, Tectaria lacei, Tectaria laotica, Tectaria latifolia, Tectaria lawrenceana, Tectaria laxa, Tectaria leptophylla, Tectaria lifuensis, Tectaria lizarzaburui, Tectaria lobbii, Tectaria lombokensis, Tectaria macrosora, Tectaria macrota, Tectaria madagascarica, Tectaria magnifica, Tectaria manilensis, Tectaria marchionica, Tectaria media, Tectaria melanocaulis, Tectaria melanocauloides, Tectaria melanorachis, Tectaria menyanthidis, Tectaria mesodon, Tectaria mexicana, Tectaria microchlamys, Tectaria microlepis, Tectaria minuta, Tectaria moorei, Tectaria morlae, Tectaria moussetii, Tectaria murrayi, Tectaria nabirensis, Tectaria nausoriensis, Tectaria nebulosa, Tectaria nesiotica, Tectaria nicaraguensis, Tectaria nicotianifolia,*

*Tectaria nitens, Tectaria novoguineensis, Tectaria organensis, Tectaria palmate, Tectaria pandurifolia, Tectaria pedata, Tectaria pentagonalis, Tectaria perdimorpha, Tectaria phaeocaulis, Tectaria pica, Tectaria pilosa, Tectaria plantaginea, Tectaria pleiosora, Tectaria pleiotoma, Tectaria poilanei, Tectaria polymorpha, Tectaria prolifera, Tectaria pseudosinuata, Tectariaxpteropus-minor, Tectaria pubens, Tectaria puberula, Tectaria pubescens, Tectaria quinquefida, Tectaria quitensis, Tectaria ramosii, Tectaria rara, Tectaria remotipinna, Tectaria repanda, Tectaria rheophytica, Tectaria rigida, Tectaria rivalis, Tectaria rockii Tectaria rufescens, Tectaria rufovillosa, Tectaria sagenioides, Tectaria schmutzii, Tectaria schultzei, Tectaria seemannii, Tectaria semibipinnata, Tectaria semipinnata, Tectaria seramensis, Tectaria siifolia, Tectaria simaoensis, Tectaria simonsii Tectaria simulans, Tectaria singaporeana, Tectaria sinuata, Tectaria squamipes, Tectaria stalactica, Tectaria steamsii, Tectaria stenosemioides, Tectaria subcaudata, Tectaria subconfluens, Tectaria subcordata, Tectaria subdigitata, Tectaria subebenea, Tectaria subrepanda, Tectaria subsageniacea, Tectaria subtriloba, Tectaria subtriphylla, Tectaria sulitii, Tectaria suluensis, Tectaria sumatrana, Tectaria tabonensis, Tectaria taccifolia, Tectaria tahitensis, Tectaria tenerifrons, Tectaria tenuifolia, Tectaria teratocarpa, Tectaria ternata, Tectaria transiens, Tectaria translucens, Tectaria tricuspis, Tectaria trifida, Tectaria trifoliata, Tectaria triglossa, Tectaria triloba, Tectaria trimenii Tectaria trinitensis, Tectaria tripartita, Tectaria variabilis, Tectaria vasta, Tectaria vieillardii, Tectaria villosa, Tectaria vitiensis, Tectaria vivipara, Tectaria waterlotii, Tectaria weberi, Tectaria wightii Tectariaxamesiana, Tectariaxcynthiae, Tectaria yunnanensis, Tectaria zeylanica,* and *Tectaria zollingeri.*

In some embodiments, the IPD113 polypeptide is derived from a fern species in the Order Polypodiales, Family Davalliaceae.

In some embodiments, the IPD113 polypeptide is derived from a fern species in the Order Polypodiales, Family Davalliaceae Genus *Davallia* selected from, but not limited to, *Davallia adiantoides, Davallia amabilis, Davallia assamica, Davallia austrosinica, Davallia biflora, Davallia boryana, Davallia brachypoda, Davallia brevisora, Davallia bullata, Davallia bullata, Davallia calvescens, Davallia calvescens, Davallia canariensis, Davallia chaerophylla, Davallia chaerophylloide, Davallia chlysanthemifolia, Davallia clarkei, Davallia cumingii Davallia cylindrica, Davallia divaricata, Davallia divaricata, Davallia divaricata var. orientale, Davallia domingensis, Davallia dubia, Davallia elmeri, Davallia falcata, Davallia falcinella, Davallia ferulacea, Davallia flaccida, Davallia formosana, Davallia fumarioides, Davallia goudotiana, Davallia gracilis, Davallia griffithiana, Davallia griffithiana, Davallia henryana, Davallia heterophylla, Davallia hookeriana, Davallia hymenophylloides, Davallia immersa, Davallia inaequalis var. minor, Davallia jamaicensis, Davallia khasiyana, Davallia kurzii, Davallia lepida, Davallia lepida, Davallia macraeana, Davallia magellanica, Davallia mariesii Davallia membranulosa, Davallia membranulosa, Davallia millefolium, Davallia moorei, Davallia multidentata, Davallia nodosa, Davallia novae-guineae, Davallia orientalis, Davallia parallela, Davallia parkeri, Davallia parvipinnula, Davallia patens, Davallia pectinata, Davallia perdurans, Davallia pilosula, Davallia platylepis, Davallia polypodioides, Davallia polypodioides var. hispida, Davallia polypodioides var. pilosula, Davallia pseudocystopteris, Davallia puberula, Davallia pyramidata, Davallia pyxidata, Davallia repens, Davallia rhomboidea, Davallia rhomboidea, Davallia rhomboidea, Davallia sinensis, Davallia sloanei, Davallia solida, Davallia solida, Davallia stipellata, Davallia strigosa, Davallia strigosa, Davallia strigosa var. rhomboidea, Davallia subalpina, Davallia subsolida, Davallia teyermannii, Davallia triangularis, Davallia tripinnata, Davallia truncata, Davallia tyermanni, Davallia tyermannii, Davallia uncinella, Davallia urophylla, Davallia vestita, Davallia wilfordii* var. *contracta,* and *Davallia yunnanensis.*

In some embodiments, the IPD113 polypeptide is derived from a fern species in the Order Polypodiales, Family Dryopteridaceae.

In some embodiments, the IPD113 polypeptide is derived from a fern species in the Order Polypodiales, Family Dryopteridaceae, Genus *Polystichum* selected from, but not limited to, *Polystichum acanthophyllum, Polystichum aculeatum, Polystichum acutidens, Polystichum acutipinnulum, Polystichum adungense, Polystichum alcicorne, Polystichum altum, Polystichum anomalum, Polystichum ariticulatipilosum, Polystichum assurgentipinnum, Polystichum atkinsonii, Polystichum attenuatum, Polystichum auriculum, Polystichum bakerianum, Polystichum baoxingense, Polystichum biaristatum, Polystichum bifidum, Polystichum bigemmatum, Polystichum bissectum, Polystichum bomiense, Polystichum brachypterum, Polystichum braunii, Polystichum capillipes, Polystichum castaneum, Polystichum chingiae, Polystichum christii, Polystichum chunii, Polystichum consimile, Polystichum costularisorum, Polystichum craspedosorum, Polystichum crassinervium, Polystichum cringerum, Polystichum cuneatiforme, Polystichum cyclolobum, Polystichum daguanense, Polystichum dangii, Polystichum delavayi, Polystichum deltodon, Polystichum dielsii, Polystichum diffundens, Polystichum discretum, Polystichum disjunctum, Polystichum duthiei, Polystichum elevatovenusum, Polystichum erosum, Polystichum exauriforme, Polystichum excellens, Polystichum excelsius, Polystichum fimbriatum, Polystichum formosanum, Polystichum frigidicola, Polystichum fugongense, Polystichum gongboense, Polystichum grandifrons, Polystichum guangxiense, Polystichum gymnocarpium, Polystichum habaense, Polystichum hancockii, Polystichum hecatopteron, Polystichum herbaceum, Polystichum houchangense, Polystichum huae, Polystichum ichangense, Polystichum inaense, Polystichum incisopinnulum, Polystichum integrilimbum, Polystichum integrilobum, Polystichum jinfoshaense, Polystichum jiulaodongense, Polystichum jizhushanense, Polystichum kangdingense, Polystichum kungianum, Polystichum kwangtungense, Polystichum lachenense, Polystichum lanceolatum, Polystichumlangchungense, Polystichum latilepis, Polystichum lentum, Polystichum leveillei, Polystichum liui, Polystichum lonchitis, Polystichum longiaristatum, Polystichum longidens, Polystichum longipaleatum, Polystichum longipes, Polystichum longipinnulum, Polystichum longispinosum, Polystichum longissimum, Polystichum macrochlaenum, Polystichum makinoi, Polystichum manmeiense, Polystichum marfinii, Polystichum mayebarae, Polystichum medogense, Polystichum mehrae, Polystichum meiguense, Polystichum melanostipes, Polystichum mollissimum, Polystichum morii, Polystichum moupinense, Polystichum muscicola, Polystichum nayongense, Polystichum neofiuii, Polystichum neolobatum, Polystichum nepalense, Polystichum nigrum, Polystichum ningshenense, Polystichum nudisorum, Polystichum obliquum, Polystichum oblongum, Polystichum oligocarpum, Polystichum omeiense, Polystichum oreodoxa, Polystichum orientalitibeticum, Polystichum otophorum, Polystichum ovato-paleaceum, Polystichum paramoupinense, Polystichum parvifoli-* olatum, Polystichum parvipinnulum, Polystichum pianmaense, Polystichum piceo-paleaceum, Polystichum polyblepharum, Polystichum prescottianum, Polystichum prionolepis, Polystichum pseudocastaneum, Polystichum pseudolanceolatum, Polystichum pseudomakinoi, Polystichum pseudorhomboideum, Polystichum pseudosetosum, Polystichum pseudoxiphophyllum, Polystichum punctiferum, Polystichum puteicola, Polystichum pycnopterum, Polystichum qamdoense, Polystichum retrosopaleaceum, Polystichum revolutum, Polystichum rhombiforme, Polystichum rigens, Polystichum robustum, Polystichum rufopaleaceum, Polystichum saxicola, Polystichum semifertile, Polystichum setillosum, Polystichum shandongense, Polystichum shensiense, Polystichum shimurae, Polystichum simplicipinnum, Polystichum sinense, Polystichum sinotsussimense, Polystichum sozanense, Polystichum speluncicola, Polystichum squarrosum, Polystichum stenophyllum, Polystichum stimulans, Polystichum subacutidens, Polystichum subdeltodon, Polystichum subfimbriatum, Polystichum submarginale, Polystichum submite, Polystichum subulatum, Polystichum tacticopterum, Polystichum taizhongense, Polystichum tangmaiense, Polystichum thomsonii, Polystichum tibeticum, Polystichum tonkinense, Polystichum tripteron, Polystichum tsingkanshanense, Polystichum tsussimense, Polystichum wattii, Polystichum xiphophyllum, Polystichum yadongense, Polystichum yuanum, Polystichum yunnanense, and Polystichum zayuense.

In some embodiments, the IPD113 polypeptide is derived from a fern species in the Order Polypodiales, Family Pteridaceae, Genus Adiantaceae selected from, but not limited to, Adiantum aethiopicum, Adiantum aleuticum, Adiantum bonatianum, Adiantum cajennense, Adiantum capillus-junonis, Adiantum capillus-veneris, Adiantum caudatum, Adiantum chienii, Adiantum chilense, Adiantum cuneatum, Adiantum cunninghamii, Adiantum davidii, Adiantum diaphanum, Adiantum edentulum, Adiantum edgeworthii, Adiantum excisum, Adiantum fengianum, Adiantum fimbriatum, Adiantum flabellulatum, Adiantum formosanum, Adiantum formosum, Adiantum fulvum, Adiantum gravesii, Adiantum hispidulum, Adiantum induratum, Adiantum jordanii, Adiantum juxtapositum, Adiantum latifolium, Adiantum leveillei, Adiantum lianxianense, Adiantum malesianum, Adiantum mariesii, Adiantum monochlamys, Adiantum myriosorum, Adiantum obliquum, Adiantum ogasawarense, Adiantum pedatum, Adiantum pentadactylon, Adiantum peruvianum, Adiantum philippense, Adiantum princeps, Adiantum pubescens, Adiantum raddianum, Adiantum reniforme, Adiantum roborowskii, Adiantum serratodentatum, Adiantum sinicum, Adiantum soboliferum, Adiantum subcordatum, Adiantum tenerum, Adiantum terminatum, Adiantum tetraphyllum, Adiantum venustum, Adiantum viridescens, and Adiantum viridimontanum.

In some embodiments, the IPD113 polypeptide is derived from a fern species in the Order Polypodiales, Family Aspleniaceae, Genus Asplenium. In some embodiments, the nucleic acid molecule encoding the IPD113 polypeptide is derived from a fern species in the Order Polypodiales, Family Aspleniaceae, Genus Asplenium L selected from, but not limited to, Asplenium abbreviatum, Asplenium abrotanoides, Asplenium abscissum var. subaequilaterale, Asplenium abscissum, Asplenium achilleifolium, Asplenium acuminatum, Asplenium adiantifrons, Asplenium adiantoides, Asplenium adiantoides var. squamulosum, Asplenium adiantum-nigrum L., Asplenium adiantum-nigrum var. adiantum-nigrum, Asplenium adiantum-nigrum var. yuanum, Asplenium adnatum, Asplenium aethiopicum, Asplenium affine, Asplenium affine var. affine, Asplenium affine var. gilpinae, Asplenium affine var. mettenii, Asplenium affine var. pecten, Asplenium africanum, Asplenium afzefii, Asplenium aitchisonii, Asplenium alatulum, Asplenium alatum, Asplenium alfredii, Asplenium altajense, Asplenium amabile, Asplenium ambohitantelense, Asplenium anceps var. proliferum, Asplenium andapense, Asplenium andersonii, Asplenium angustatum, Asplenium angustum, Asplenium anisophyllum, Asplenium annetii, Asplenium antiquum, Asplenium antrophyoides, Asplenium apertum, Asplenium apogamum, Asplenium aquaticum, Asplenium arboreum, Asplenium arcanum, Asplenium arcuatum, Asplenium argentinum, Asplenium argutum, Asplenium aspidiiforme, Asplenium aspidioides, Asplenium asterolepis, Asplenium auricularium var. acutidens, Asplenium auricularium var. subintegerrimum, Asplenium auriculatum, Asplenium auriculatum var. aequilaterale, Asplenium auritum, Asplenium auritum var. auriculatum, Asplenium auritum var. auritum, Asplenium auritum var. bipinnatifidum, Asplenium auritum var. bipinnatisectum, Asplenium auritum var. davallioides, Asplenium auritum var. macilentum, Asplenium auritum var. rigidum, Asplenium auritum var. subsimplex, Asplenium austrochinense, Asplenium ayopayense, Asplenium badinii, Asplenium balense, Asplenium balfivianii, Asplenium bangii, Asplenium bangii, Asplenium barbaense, Asplenium barclayanum, Asplenium barkamense, Asplenium barteri, Asplenium basiscopicum, Asplenium bicrenatum, Asplenium bifrons, Asplenium bipartitum, Asplenium blastophorum, Asplenium blepharodes, Asplenium blepharophorum, Asplenium boiteaui, Asplenium bolivianum, Asplenium boltonii, Asplenium borealichinense, Asplenium bradei, Asplenium bradeorum, Asplenium bradleyi, Asplenium brausei, Asplenium breedlovei, Asplenium buettneri, Asplenium buettneri var. hildebrandfii, Asplenium bulbiferum, Asplenium bullatum var. bullatum, Asplenium bullatum var. shikokianum, Asplenium bullatum, Asplenium cancellatum, Asplenium capillipes, Asplenium cardiophyllum (Hance), Asplenium caripense, Asplenium carvalhoanum, Asplenium castaneoviride, Asplenium castaneum, Asplenium caudatum, Asplenium celtidifolium (Kunze), Asplenium ceratolepis, Asplenium changputungense, Asplenium chaseanum, Asplenium cheilosorum, Asplenium chengkouense, Asplenium chihuahuense, Asplenium chimantae, Asplenium chimborazense, Asplenium chingianum, Asplenium chlorophyllum, Asplenium chondrophyllum, Asplenium cicutarium, Asplenium cicutarium var. paleaceum, Asplenium cirrhatum, Asplenium cladolepton, Asplenium claussenii, Asplenium coenobiale, Asplenium commutatum, Asplenium congestum, Asplenium conquisitum, Asplenium consimile, Asplenium contiguum, Asplenium contiguum var. hirtulum, Asplenium corderoi, Asplenium cordovense, Asplenium coriaceum, Asplenium coriifolium, Asplenium correardii, Asplenium costale, Asplenium costale var. robustum, Asplenium cowanii, Asplenium crenulatoserrulatum, Asplenium crenulatum, Asplenium crinicaule, Asplenium crinulosum, Asplenium cristatum, Asplenium cryptolepis Fernald, Asplenium cultrifolium L., Asplenium cuneatiforme, Asplenium cuneatum, Asplenium curvatum, Asplenium cuspidatum, Asplenium cuspidatum var cuspidatum, Asplenium cuspidatum var. foeniculaceum, Asplenium cuspidatum var. triculum, Asplenium cuspidatum var. tripinnatum, Asplenium dalhousiae, Asplenium dareoides, Asplenium davallioides, Asplenium davisii, Asplenium debile, Asplenium debile, Asplenium decussatum, Asplenium delavayi, Asplenium delicatulum, Asplenium delicatulum var. cocosensis, Asplenium delitescens, Asplenium delitescens×laetum, Asplenium densum, Asplenium dentatum L., Asplenium dentatum L., Asplenium depauperatum, Asplenium deqenense, Asplenium

*dianae, Asplenium difforme, Asplenium dilatatum, Asplenium dimidiatum, Asplenium dimidiatum* var. *boliviense, Asplenium diplazisorum, Asplenium dissectum, Asplenium distans, Asplenium divaricatum, Asplenium divergens, Asplenium divisissimum, Asplenium doederleinii, Asplenium donnell-smithii, Asplenium dregeanum, Asplenium dulongjiangense, Asplenium duplicatoserratum, Asplenium eatonii, Asplenium ebeneum, Asplenium ebenoides, Asplenium ecuadorense, Asplenium eggersii, Asplenium emarginatum, Asplenium enatum, Asplenium ensiforme* fo. *bicuspe, Asplenium ensiforme* fo. *ensiforme, Asplenium ensiforme* fo. *stenophyllum, Asplenium ensiforme, Asplenium erectum* var. *erectum, Asplenium erectum* var. *gracile, Asplenium erectum* var. *usambarense, Asplenium erectum* var. *zeyheri,* &, *Asplenium erosum* L., *Asplenium escaleroense, Asplenium esculentum, Asplenium eutecnum, Asplenium excelsum, Asplenium excisum, Asplenium exiguum, Asplenium extensum, Asplenium falcatum, Asplenium falcinellum, Asplenium faurei, Asplenium feel, Asplenium fengyangshanense, Asplenium ferulaceum, Asplenium fibrillosum, Asplenium filix-femina, Asplenium finckii, Asplenium finlaysonianum, Asplenium flabellulatum, Asplenium flabellulatum* var *flabellulatum, Asplenium flabellulatum* var. *partitum, Asplenium flaccidum, Asplenium flavescens, Asplenium flavidum, Asplenium flexuosum, Asplenium fluminense, Asplenium foeniculaceum, Asplenium formosanum, Asplenium formosum* var. *carolinum, Asplenium formosum* var. *incultum, Asplenium formosum, Asplenium foumieri, Asplenium fragile, Asplenium fragile* var. *lomense, Asplenium fragrans, Asplenium fragrans* var. *foeniculaceum, Asplenium franconis* var. *gracile, Asplenium fraxinifolium, Asplenium friesiorum, Asplenium friesiorum* var. *nesophilum, Asplenium fugax, Asplenium fujianense, Asplenium furcatum, Asplenium furfuraceum, Asplenium fuscipes, Asplenium fuscopubescens, Asplenium galeottii, Asplenium gautieri, Asplenium gemmiferum, Asplenium genfiyi, Asplenium geppii, Asplenium ghiesbreghtii, Asplenium gilfiesii, Asplenium gilpinae, Asplenium glanduliserratum, Asplenium glenniei, Asplenium goldmannii, Asplenium gomezianum, Asplenium grande, Asplenium grandifolium, Asplenium grandifrons, Asplenium gregoriae, Asplenium griffithianum, Asplenium gulingense, Asplenium hainanense, Asplenium hallbergii, Asplenium hallei, Asplenium hallii, Asplenium hangzhouense, Asplenium haplophyllum, Asplenium harpeodes, Asplenium harpeodes* var. *glaucovirens, Asplenium harpeodes* var. *incisum, Asplenium harrisii Jenman, Asplenium harrisonii, Asplenium hastatum, Asplenium hebeiense, Asplenium hemionitideum, Asplenium hemitomum, Asplenium henryi, Asplenium herpetopteris, Asplenium herpetopteris* var *herpetopteris, Asplenium herpetopteris* var. *acutipinnata, Asplenium herpetopteris* var. *masoulae, Asplenium herpetopteris* var. *villosum, Asplenium hesperium, Asplenium heterochroum, Asplenium hians, Asplenium hians* var. *pallescens, Asplenium hoffmannii, Asplenium holophlebium, Asplenium hondoense, Asplenium horridum, Asplenium hostmannii, Asplenium humistratum, Asplenium hypomelas, Asplenium inaequilaterale, Asplenium incisum, Asplenium incurvatum, Asplenium indicum, Asplenium indicum* var. *indicum, Asplenium indicum* var. *yoshingagae, Asplenium induratum, Asplenium indusiatum, Asplenium inexpectatum, Asplenium insigne, Asplenium insiticium, Asplenium insolitum, Asplenium integerrimum, Asplenium interjectum, Asplenium jamesonii, Asplenium jaundeense, Asplenium juglandifolium, Asplenium kangdingense, Asplenium kansuense, Asplenium kassneri, Asplenium kaulfussii, Asplenium kellermanii, Asplenium kentuckiense, Asplenium khullarii, Asplenium kiangsuense, Asplenium kunzeanum, Asplenium lacerum, Asplenium laciniatum, Asplenium laciniatum* var. *acutipinna, Asplenium laciniatum* var. *laciniatum, Asplenium laetum* fo. *minor, Asplenium laetum, Asplenium laetum* var. *incisoserratum, Asplenium lamprocaulon, Asplenium laserpillifolium* var. *morrisonense, Asplenium lastii, Asplenium latedens, Asplenium latifolium, Asplenium laui, Asplenium laurentii, Asplenium leandrianum, Asplenium lechleri, Asplenium leiboense, Asplenium lepidorachis, Asplenium leptochlamys, Asplenium leptophyllum, Asplenium levyi, Asplenium findbergii, Asplenium lindeni, Asplenium lineatum, Asplenium lividum, Asplenium lobatum, Asplenium lobulatum, Asplenium lokohoense, Asplenium longicauda, Asplenium longicaudatum, Asplenium longifolium, Asplenium longisorum, Asplenium longjinense, Asplenium lorentzii, Asplenium loriceum, Asplenium loxogrammoides, Asplenium lugubre, Asplenium lunulatum, Asplenium lunulatum* var. *pteropus, Asplenium lushanense, Asplenium lydgatei, Asplenium macilentum, Asplenium macraei, Asplenium macrodictyon, Asplenium macrophlebium, Asplenium macrophyllum, Asplenium macropterum, Asplenium macrosorum, Asplenium macrotis, Asplenium macrurum, Asplenium mainlingense, Asplenium mangindranense, Asplenium mannii, Asplenium marginatum* L., *Asplenium marojejyense, Asplenium martianum, Asplenium matsumurae, Asplenium mauritiensis Lorence, Asplenium maximum, Asplenium, ii, Asplenium megalura, Asplenium megaphyllum, Asplenium meiotomum, Asplenium melanopus, Asplenium membranifolium, Asplenium meniscioides, Asplenium mesosorum, Asplenium mexicanum, Asplenium micropaleatum, Asplenium microtum, Asplenium mildbraedii, Asplenium mildei, Asplenium minimum, Asplenium minutum, Asplenium miradorense, Asplenium miyunense, Asplenium moccenianum, Asplenium mocquerysii, Asplenium modestum, Asplenium monanthemum* var. *menziesii, Asplenium monanthes* L., *Asplenium monanthes* var *monanthes, Asplenium monanthes* var. *castaneum, Asplenium monanthes* var. *wagneri, Asplenium monanthes* var. *yungense, Asplenium monodon, Asplenium montanum, Asplenium mosetenense, Asplenium moupinense, Asplenium mucronatum, Asplenium munchii, Asplenium muticum, Asplenium myapteron, Asplenium myriophyllu, Asplenium nakanoanum, Asplenium nanchuanense, Asplenium nemorale, Asplenium neolaserpitiifolium, Asplenium neomutijugum, Asplenium neovarians, Asplenium nesii, Asplenium nesioticum, Asplenium nidus* L., *Asplenium nigricans, Asplenium niponicum, Asplenium normae, Asplenium normae* var. *angustum, Asplenium obesum, Asplenium oblongatum, Asplenium oblongifolium, Asplenium obovatum, Asplenium obscurum, Asplenium obscurum* var. *angustum, Asplenium obtusatum* var. *obtusatum, Asplenium obtusatum* var. *sphenoides, Asplenium obtusifolium* L., *Asplenium obtusissimum, Asplenium obversum, Asplenium ochraceum, Asplenium oellgaardii, Asplenium ofeliae, Asplenium oldhami, Asplenium oligosorum, Asplenium olivaceum, Asplenium onopteris* L., *Asplenium onustum, Asplenium ortegae, Asplenium otites, Asplenium palaciosii, Asplenium palmeri, Asplenium partitum, Asplenium parvisorum, Asplenium parviusculum, Asplenium parvulum, Asplenium patens, Asplenium paucifolium, Asplenium paucijugum, Asplenium paucivenosum, Asplenium pearcei, Asplenium pekinense, Asplenium pellucidum, Asplenium pendulum, Asplenium petiolulatum, Asplenium phyllitidis, Asplenium pimpinellifolium, Asplenium pinnatifidum, Asplenium pinnatum, Asplenium platyneuron, Asplenium platyneuron* var. *bacculumrubrum, Asplenium platyneuron* var. *incisum, Asplenium platyphyllum, Asplenium plumbeum, Asplenium poloense, Asplenium polymeris, Asplenium polymorphum, Asplenium* polyodon, Asplenium polyodon var. knudsenii, Asplenium polyodon var. nitidulum, Asplenium polyodon var. sectum, Asplenium polyodon var. subcaudatum, Asplenium polyphyllum, Asplenium poolii, Asplenium poolii fo. simplex, Asplenium poolii var. linearipinnatum, Asplenium potosinum, Asplenium potosinum var. incisum, Asplenium praegracile, Asplenium praemorsum, Asplenium preussii, Asplenium pringleanum, Asplenium pringlei, Asplenium prionitis, Asplenium procerum, Asplenium progrediens, Asplenium projectum, Asplenium prolongatum, Asplenium propinquum, Asplenium protensum, Asplenium pseudoangustum, Asplenium pseudoerectum, Asplenium pseudofontanum, Asplenium pseudolaserpitiifolium, Asplenium pseudonormale, Asplenium pseudopellucidum, Asplenium pseudopraemorsum, Asplenium pseudovarians, Asplenium pseudowilfordii, Asplenium pseudowrightii, Asplenium psilacrum, Asplenium pteropus, Asplenium pubirhizoma, Asplenium pulchellum, Asplenium pulchellum var. subhorizontale, Asplenium pulcherrimum, Asplenium pulicosum, Asplenium pulicosum var. maius, Asplenium pululahuae, Asplenium pumilum, Asplenium pumilum var. hymenophylloides, Asplenium pumilum var. laciniatum, Asplenium purdieanum, Asplenium purpurascens, Asplenium pyramidatum, Asplenium qiujiangense, Asplenium quercicola, Asplenium quitense, Asplenium raddianum, Asplenium radiatum, Asplenium radicans L., Asplenium radicans, Asplenium radicans var. costaricense, Asplenium radicans var. partitum, Asplenium radicans var. radicans, Asplenium radicans var. uniseriale, Asplenium recumbens, Asplenium reflexum, Asplenium regulare var. latior, Asplenium repandulum, Asplenium repens, Asplenium repente, Asplenium resiliens, Asplenium retusulum, Asplenium rhipidoneuron, Asplenium rhizophorum L., Asplenium rhizophyllum, Asplenium rhizophyllum L., Asplenium rhizophyllum var. proliferum, Asplenium rhomboideum, Asplenium rigidum, Asplenium riparium, Asplenium rivale, Asplenium rockii, Asplenium roemerianum, Asplenium roemerianum var. mindensis, Asplenium rosenstockianum, Asplenium rubinum, Asplenium ruizianum, Asplenium rusbyanum, Asplenium ruta-muraria L., Asplenium ruta-muraria var. cryptolepis, Asplenium rutaceum, Asplenium rutaceum var. disculiferum, Asplenium rutaefolium, Asplenium rutifolium, Asplenium salicifolium L., Asplenium salicifolium var. aequilaterale, Asplenium salicifolium var. salicifolium, Asplenium sampsoni, Asplenium sanchezii, Asplenium sanderi, Asplenium sandersonii, Asplenium sanguinolentum, Asplenium sarelii, Asplenium sarelii var. magnum, Asplenium sarelii var. sarelii, Asplenium saxicola, Asplenium scalifolium, Asplenium scandicinum, Asplenium schizophyllum, Asplenium schkuhrii, Asplenium sciadophilum, Asplenium scolopendrium L., Asplenium scortechinii, Asplenium seileri, Asplenium semipinnatum, Asplenium septentrionale, Asplenium serra, Asplenium serra var. imrayanum, Asplenium serratissimum, Asplenium serratum L., Asplenium serratum var. caudatum, Asplenium serricula, Asplenium sessilifolium, Asplenium sessilifolium var. guatemalense, Asplenium sessilifolium var. minus, Asplenium sessilifolium var. occidentale, Asplenium sessilipinnum, Asplenium setosum, Asplenium shepherdii, Asplenium shepherdii var. bipinnatum, Asplenium shepherdii var. flagelliferum, Asplenium shikokianum, Asplenium simii, Asplenium simonsianum, Asplenium sintenisii, Asplenium skinneri, Asplenium skinneri, Asplenium sodiroi, Asplenium soleirolioides, Asplenium solidum var. stenophyllum, Asplenium solmsii, Asplenium sp.-N.-Halle-2234, Asplenium spathulinum, Asplenium spectabile, Asplenium speluncae, Asplenium sphaerosporum, Asplenium sphenotomum, Asplenium spinescens, Asplenium splendens, Asplenium sprucei, Asplenium squamosum L., Asplenium standleyi, Asplenium stellatum, Asplenium stenocarpum, Asplenium stoloniferum, Asplenium stolonipes, Asplenium striatum L., Asplenium stuebelianum, Asplenium stuhlmannii, Asplenium suave, Asplenium subalatum, Asplenium subcrenatum, Asplenium subdigitatum, Asplenium subdimidiatum, Asplenium subintegrum, Asplenium sublaserpitiifolium, Asplenium sublongum, Asplenium subnudum, Asplenium suborbiculare, Asplenium subtenuifolium, Asplenium subtile, Asplenium subtoramanum, Asplenium subtrapezoideum, Asplenium subvarians, Asplenium sulcatum, Asplenium sylvaticum, Asplenium szechuanense, Asplenium taiwanense, Asplenium tenerrimum, Asplenium tenerum, Asplenium tenuicaule, Asplenium tenuifolium, Asplenium tenuifolium var. minor, Asplenium tenuifolium var. tenuifolium, Asplenium tenuissimum, Asplenium ternatum, Asplenium theciferum, Asplenium theciferum var. concinnum, Asplenium thunbergii, Asplenium tianmushanense, Asplenium tianshanense, Asplenium tibeticum, Asplenium tocoraniense, Asplenium toramanum, Asplenium trapezoideum, Asplenium tricholepis, Asplenium trichomanes L., Asplenium trichomanes subsp. inexpectans, Asplenium trichomanes subsp. quadrivalens, Asplenium trichomanes subsp. trichomanes, Asplenium trichomanes var. harovii, Asplenium trichomanes var. herbaceum, Asplenium trichomanes var. repens, Asplenium trichomanes var. viridissimum, Asplenium trichomanes-dentatum L., Asplenium trigonopterum, Asplenium trilobatum, Asplenium trilobum, Asplenium triphyllum, Asplenium triphyllum var. compactum, Asplenium triphyllum var. gracillimum, Asplenium triphyllum var. herbaceum, Asplenium tripteropus, Asplenium triquetrum, Asplenium truncorum, Asplenium tsaratananense, Asplenium tucumanense, Asplenium tuerckheimii, Asplenium tunquiniense, Asplenium ulbrichtii, Asplenium ultimum, Asplenium unilaterale, Asplenium unilaterale var. decurrens, Asplenium unilaterale var. udum, Asplenium unilaterale var. unilaterale, Asplenium uniseriale, Asplenium uropteron, Asplenium vagans, Asplenium vareschianum, Asplenium variabile var. paucijugum, Asplenium variabile var. variabile, Asplenium varians subsp. fimbriatum, Asplenium varians, Asplenium vastum, Asplenium venturae, Asplenium venulosum, Asplenium verapax, Asplenium vesiculosum, Asplenium vespertinum, Asplenium villosum, Asplenium virens, Asplenium viride, Asplenium viridifrons, Asplenium virillae, Asplenium viviparioides, Asplenium viviparum, Asplenium viviparum var viviparum, Asplenium viviparum var. lineatu, Asplenium volubile, Asplenium vulcanicum, Asplenium wacketii, Asplenium wagneri, Asplenium wallichianum, Asplenium wameckei, Asplenium wilfordii, Asplenium williamsii, Asplenium wrightii, Asplenium wrightioides, Asplenium wuliangshanense, Asplenium xianqianense, Asplenium xinjiangense, Asplenium xinyiense, Asplenium yelagagense, Asplenium yoshinagae, Asplenium yunnanense, Asplenium zamiifolium, Asplenium zanzibaricum, Asplenium biscayneanum, Asplenium curtissii, Asplenium ebenoides, Asplenium herb-wagneri, Asplenium heteroresiliens, Asplenium kenzoi, Asplenium plenum, Asplenium wangii, and Asplenium xclermontiae, Asplenium xgravesii.

In some embodiments, the IPD113 polypeptide is derived from a fern species in the Order Polypodiales, Family Blechnaceae, Genus *Blechnum* L. In some embodiments, the nucleic acid molecule encoding the IPD113 polypeptide is derived from a fern species in the Order Polypodiales, Family Blechnaceae, Genus *Blechnum* L. selected from, but not limited to, *Blechnum amabile, Blechnum appendiculatum, Blechnum articulatum, Blechnum australe, Blechnum austrobrasilianum, Blechnum binervatum, Blechnum blech-* noides, *Blechnum brasiliense*, *Blechnum capense*, *Blechnum cartilagineum*, *Blechnum castaneum*, *Blechnum chambersii*, *Blechnum chilense*, *Blechnum colensoi*, *Blechnum contiguum*, *Blechnum cordatum*, *Blechnum coriaceum*, *Blechnum discolor*, *Blechnum doodioides*, *Blechnum durum*, *Blechnum eburneum*, *Blechnum ensiforme*, *Blechnum filiforme*, *Blechnum fluviatile*, *Blechnum fragile*, *Blechnum fraseri*, *Blechnum fullagari*, *Blechnum gibbum*, *Blechnum glandulosum*, *Blechnum gracile*, *Blechnum hancockii*, *Blechnum hastatum*, *Blechnum howeanum*, *Blechnum indicum*, *Blechnum kunthianum*, *Blechnum laevigatum*, *Blechnum loxense*, *Blechnum magellanicum*, *Blechnum membranaceum*, *Blechnum microbasis*, *Blechnum microphyllum*, *Blechnum milnei*, *Blechnum minus*, *Blechnum mochaenum*, *Blechnum montanum*, *Blechnum moorei*, *Blechnum moritzianum*, *Blechnum nigrum*, *Blechnum niponicum*, *Blechnum norfolkianum*, *Blechnum novae-zelandiae*, *Blechnum nudum*, *Blechnum obtusatum*, *Blechnum occidentale*, *Blechnum oceanicum*, *Blechnum orientale*, *Blechnum patersonii*, *Blechnum penna-marina*, *Blechnum polypodioides*, *Blechnum procerum*, *Blechnum punctulatum*, *Blechnum sampaioanum*, *Blechnum schiedeanum*, *Blechnum schomburgkii*, *Blechnum serrulatum*, *Blechnum simillimum*, *Blechnum spicant*, *Blechnum stipitellatum*, *Blechnum tabulare*, *Blechnum triangularifolium*, *Blechnum vieillardii*, *Blechnum vulcanicum*, *Blechnum wattsii*, *Blechnum whelanii*, and *Blechnum wurunuran*.

In some embodiments, the nucleic acid encoding the IPD113 polypeptide is derived from a fern species in the Order Schizaeales; Family Schizaeaceae, Genus *Lygodium* selected from, but not limited to, *Lygodium articulatum*, *Lygodium circinatum*, *Lygodium conforme*, *Lygodium cubense*, *Lygodium digitatum*, *Lygodium flexuosum*, *Lygodium heterodoxum*, *Lygodium japonicum*, *Lygodium kerstenii*, *Lygodium lanceolatum*, *Lygodium longifollurn*, *Lygodium merrilii*, *Lygodium micans*, *Lygodium microphyllum*, *Lygodium microstachyum*, *Lygodium oligostachyum*, *Lygodium palmatum*, *Lygodium polystachyum*, *Lygodium radiatum*, *Lygodium reticulatum*, *Lygodium salicifolium*, *Lygodium scandens*, *Lygodium smithianum*, *Lygodium subareolatum*, *Lygodium trifurcatum*, *Lygodium venustum*, *Lygodium versteeghii*, *Lygodium volubile*, and *Lygodium yunnanense*.

In some embodiments, the IPD113 polypeptide is derived from a fern species in the Genus *Ophioglossum* L., *Botrychium*, *Botrypus*, *Helminthostachys*, *Ophioderma*, *Cheiroglossa*, *Sceptridium* or *Mankyua*. In some embodiments, the IPD113 polypeptide is derived from a fern species in the *Ophioglossum* Genus is selected from, but not limited to, *Ophioglossum californicum*, *Ophioglossum coriaceum*, *Ophioglossum costatum*, *Ophioglossum crotalophoroides*, *Ophioglossum engelmannii*, *Ophioglossum falcatum*, *Ophioglossum gomezianum*, *Ophioglossum gramineum*, *Ophioglossum kawamurae*, *Ophioglossum lusitanicum*, *Ophioglossum namegatae*, *Ophioglossum nudicaule*, *Ophioglossum palmatum*, *Ophioglossum parvum*, *Ophioglossum pedunculosum*, *Ophioglossum pendulum*, *Ophioglossum petiolatum*, *Ophioglossum pusillum*, *Ophioglossum reticulatum*, *Ophioglossum richardsiae*, *Ophioglossum thermale*, and *Ophioglossum vulgatum*.

In some embodiments, the IPD113 polypeptide is derived from a fern species in the *Pyrrosia* Genus selected from, but not limited to, *Pyrrosia abbreviata*, *Pyrrosia angustata*, *Pyrrosia angustissima*, *Pyrrosia assimilis*, *Pyrrosia asterosora*, *Pyrrosia blepharolepis*, *Pyrrosia boothii*, *Pyrrosia borneensis*, *Pyrrosia brassii*, *Pyrrosia christii*, *Pyrrosia confluens*, *Pyrrosia costata*, *Pyrrosia dimorpha*, *Pyrrosia dispar*, *Pyrrosia distichocarpa*, *Pyrrosia drakeana*, *Pyrrosia eleagnifolia*, *Pyrrosia fengiana*, *Pyrrosia flocculosa*, *Pyrrosia foveolata*, *Pyrrosia fuohaiensis*, *Pyrrosia gardneri*, *Pyrrosia hastata*, *Pyrrosia heterophylla*, *Pyrrosia intermedia*, *Pyrrosia laevis*, *Pyrrosia lanceolata*, *Pyrrosia liebuschii*, *Pyrrosia linearifolia*, *Pyrrosia lingua*, *Pyrrosia longifolia*, *Pyrrosia macrocarpa*, *Pyrrosia madagascariensis*, *Pyrrosia matsudai*, *Pyrrosia mechowii*, *Pyrrosia micraster*, *Pyrrosia mollis*, *Pyrrosia novo-guineae*, *Pyrrosia nummularfifofia*, *Pyrrosia oblanceolata*, *Pyrrosia obovata*, *Pyrrosia pannosa*, *Pyrrosia petiolosa*, *Pyrrosia piloselloides*, *Pyrrosia polydactyla*, *Pyrrosia porosa*, *Pyrrosia princeps*, *Pyrrosia pseudodrakeana*, *Pyrrosia rasamalae*, *Pyrrosia rhodesiana*, *Pyrrosia rupestris*, *Pyrrosia samarensis*, *Pyrrosia scolopendrina*, *Pyrrosia sheareri*, *Pyrrosia shennongensis*, *Pyrrosia similis*, *Pyrrosia sphaerosticha*, *Pyrrosia stigmosa*, *Pyrrosia stolzfi*, *Pyrrosia subfurfuracea*, *Pyrrosia transmorrisonensis*, and *Pyrrosia tricholepis*.

In some embodiments, the IPD113 polypeptide is derived from a fern species in the *Doryopteris* Genus selected from, but not limited to, *Doryopteris collina*, *Doryopteris concolor*, *Doryopteris conformis*, *Doryopteris cordata*, *Doryopteris cordifolia*, *Doryopteris crenulans*, *Doryopteris cyclophylla*, *Doryopteris davidsei*, *Doryopteris decipiens*, *Doryopteris decora*, *Doryopteris effusa*, *Doryopteris humbertfi*, *Doryopteris kirkii*, *Doryopteris kitchingii*, *Doryopteris latiloba*, *Doryopteris lomariacea*, *Doryopteris lorentzii*, *Doryopteris ludens*, *Doryopteris madagascariensis*, *Doryopteris michefii*, *Doryopteris nobilis*, *Doryopteris omithopus*, *Doryopteris patens*, *Doryopteris patula*, *Doryopteris patula*, *Doryopteris pedata*, *Doryopteris pedata*, *Doryopteris pedatoides*, *Doryopteris pilosa*, *Doryopteris rediviva*, *Doryopteris sagittifolia*, *Doryopteris triphylla*, and *Doryopteris tryonii*.

In some embodiments, the IPD113 polypeptide is derived from a fern species in the *Dryopteris* Genus selected from, but not limited to, Dryopteris abbreviata, Dryopteris acuminata, *Dryopteris aemula*, *Dryopteris affinis*, *Dryopteris aitoniana*, *Dryopteris alpestris*, *Dryopteris amurensis*, *Dryopteris anadroma*, *Dryopteris antarctica*, *Dryopteris anthracinisquama*, *Dryopteris aquilinoides*, *Dryopteris ardechensis*, *Dryopteris arguta*, *Dryopteris assimilis*, *Dryopteris athamantica*, *Dryopteris atrata*, *Dryopteris austriaca*, *Dryopteris azorica*, *Dryopteris barbigera*, *Dryopteris basisora*, *Dryopteris bemieri*, *Dryopteris bissetiana*, *Dryopteris bodinieri*, *Dryopteris borreri*, *Dryopteris campyloptera*, *Dryopteris carthusiana*, *Dryopteris caucasica*, *Dryopteris caudifrons*, *Dryopteris caudipinna*, *Dryopteris celsa*, *Dryopteris championii*, *Dryopteris chinensis*, *Dryopteris chlysocoma*, *Dryopteris cinnamomea*, *Dryopteris clintoniana*, *Dryopteris cochleata*, *Dryopteris commixta*, *Dryopteris conjugata*, *Dryopteris coreanomontana*, *Dryopteris corleyi*, *Dryopteris costalisora*, *Dryopteris crassirhizoma*, *Dryopteris crinalis*, *Dryopteris crispifolia*, *Dryopteris cristata*, *Dryopteris cycadina*, *Dryopteris cyclopeltidiformis*, *Dryopteris cystolepidota*, *Dryopteris decipiens*, *Dryopteris dehuaensis*, *Dryopteris dickinsii*, *Dryopteris diffracta*, *Dryopteris dilatata*, *Dryopteris erythrosora*, *Dryopteris expansa*, *Dryopteris fatuhivensis*, *Dryopteris filix-mas*, *Dryopteris flaccisquama*, *Dryopteris formosana*, *Dryopteris fragrans*, *Dryopteris fuscipes*, *Dryopteris fuscoatra*, *Dryopteris futura*, *Dryopteris gamblei*, *Dryopteris glabra*, *Dryopteris goeringiana*, *Dryopteris goldieana*, *Dryopteris guanchica*, *Dryopteris gushanica*, *Dryopteris gymnophylla*, *Dryopteris gymnosora*, *Dryopteris hadanoi*, *Dryopteris handeliana*, *Dryopteris hangchowensis*, *Dryopteris hasseltii*, *Dryopteris hawaiiensis*, *Dryopteris hayatae*,

*Dryopteris hendersonii, Dryopteris himachalensis, Dryopteris hondoensis, Dryopteris huberi, Dryopteris hwangii, Dryopteris inaequalis, Dryopteris indusiata, Dryopteris insularis, Dryopteris integriloba, Dryopteris intermedia, Dryopteris juxtaposita, Dryopteris karwinskyana, Dryopteris kinkiensis, Dryopteris kinokuniensis, Dryopteris knoblochii, Dryopteris koidzumiana, Dryopteris komarovii, Dryopteris labordei, Dryopteris lacera, Dryopteris lachoongensis, Dryopteris laeta, Dryopteris lepidopoda, Dryopteris lepidorachis, Dryopteris liankwangensis, Dryopteris ludoviciana, Dryopteris lunanensis, Dryopteris marginalis, Dryopteris marginata, Dryopteris mauiensis, Dryopteris maximowiczii, Dryopteris maxonii, Dryopteris medioxima, Dryopteris melanocarpa, Dryopteris monticola, Dryopteris munchii, Dryopteris namegatae, Dryopteris neolacera, Dryopteris nipponensis, Dryopteris nubigena, Dryopteris odontoloma, Dryopteris oligodonta, Dryopteris oreades, Dryopteris pacifica, Dryopteris pallida, Dryopteris panda, Dryopteris paraerythrosora, Dryopteris parafuscipes, Dryopteris patula, Dryopteris pentheri, Dryopteris podophylla, Dryopteris polita, Dryopteris polylepis, Dryopteris pseudofilix-mas, Dryopteris pseudosparsa, Dryopteris pseudovaria, Dryopteris pulcherrima, Dryopteris pycnopteroides, Dryopteris redactopinnata, Dryopteris reflexosquamata, Dryopteris remota, Dryopteris rosea, Dryopteris rossii, Dryopteris rosthomii, Dryopteris rubiginosa, Dryopteris rubrobrunnea, Dryopteris ryo-itoana, Dryopteris sabae, Dryopteris sacrosancta, Dryopteris saffordii, Dryopteris salvinii, Dryopteris sandwicensis, Dryopteris saxifraga, Dryopteris saxifragivaria, Dryopteris scottii, Dryopteris setosa, Dryopteris shibipedis, Dryopteris shikokiana, Dryopteris shiroumensis, Dryopteris sichotensis, Dryopteris sieboldii, Dryopteris silaensis, Dryopteris simasakii, Dryopteris simplicior, Dryopteris sinofibrillosa, Dryopteris sinosparsa, Dryopteris sordidipes, Dryopteris sororia, Dryopteris sparsa, Dryopteris spinosa, Dryopteris squamifera, Dryopteris squamiseta, Dryopteris stenolepis, Dryopteris stewartii, Dryopteris subbipinnata, Dryopteris subexaltata, Dryopteris sublacera, Dryopteris submarginata, Dryopteris submontana, Dryopteris sub pycnopteroides, Dryopteris subreflexipinna, Dryopteris subtriangularis, Dryopteris tetrapinnata, Dryopteris tokyoensis, Dryopteris triangularis, Dryopteris tsoongii, Dryopteris tsugiwoi, Dryopteris tsutsuiana, Dryopteris unidentata, Dryopteris uniformis, Dryopteris varia, Dryopteris wallichiana, Dryopteris wattsii, Dryopteris×benedictii, Dryopteris×ebinoensis, Dryopteris×triploidea,* and *Dryopteris yakusilvicola.*

In some embodiments, the IPD113 polypeptide is derived from a fern species in the *Pellaea* Genus selected from, but not limited to, *Pellaea andromedifolia, Pellaea angulosa, Pellaea atropurpurea, Pellaea boivinii, Pellaea brachyptera, Pellaea breweri, Pellaea bridgesii, Pellaea calidirupium, Pellaea calomelanos, Pellaea cordifolia, Pellaea crenata, Pellaea cymbiformis, Pellaea doniana, Pellaea dura, Pellaea falcata, Pellaea flavescens, Pellaea glabella, Pellaea gleichenioides, Pellaea intermedia, Pellaea longipilosa, Pellaea lyngholmii, Pellaea maxima, Pellaea mucronata, Pellaea notabilis, Pellaea ovata, Pellaea paradoxa, Pellaea patula, Pellaea paupercula, Pellaea pectiniformis, Pellaea pinnata, Pellaea pringlei, Pellaea pteroides, Pellaea riedelii, Pellaea rotundifolia, Pellaea rufa, Pellaea sagittata, Pellaea* sp. UC 1795070, *Pellaea* sp. UC1788706, *Pellaea* sp. Wen 9479, *Pellaea* sp. Wen 9490, *Pellaea ternifolia, Pellaea trichophylla, Pellaea truncata, Pellaea viridis, Pellaea wrightiana,* and *Pellaea glaciogena.*

In some embodiments, the IPD113 polypeptide is derived from a fern species in the *Gymnocarpium* Genus selected from, but not limited to, *Gymnocarpium appalachianum, Gymnocarpium brittonianum, Gymnocarpium disjunctum, Gymnocarpium Dryopteris, Gymnocarpium jessoense, Gymnocarpium oyamense, Gymnocarpium remotepinnatum, Gymnocarpium robertianum,* and *Gymnocarpium* sp. TH2007-996.

In some embodiments, the IPD113 polypeptide is derived from a fern species in the *Cheilanthes* Genus selected from, but not limited to, *Cheilanthes acrostica, Cheilanthes adiantoides, Cheilanthes aemula, Cheilanthes alabamensis, Cheilanthes austrotenuifolia, Cheilanthes bonariensis, Cheilanthes brownii, Cheilanthes catanensis, Cheilanthes caudata, Cheilanthes cavernicola, Cheilanthes clevelandii, Cheilanthes contigua, Cheilanthes cooperae, Cheilanthes covillei, Cheilanthes distans, Cheilanthes eatonii, Cheilanthes feei, Cheilanthes fendleri, Cheilanthes fragillima, Cheilanthes glauca, Cheilanthes gracillima, Cheilanthes guanchica, Cheilanthes hispanica, Cheilanthes horridula, Cheilanthes humilis, Cheilanthes intertexta, Cheilanthes intramarginalis, Cheilanthes lanosa, Cheilanthes lasiophylla, Cheilanthes lendigera, Cheilanthes leucopoda, Cheilanthes lindheimeri, Cheilanthes maderensis, Cheilanthes microphylla, Cheilanthes micropteris, Cheilanthes myriophylla, Cheilanthes newberryi, Cheilanthes nitida, Cheilanthes nudiuscula, Cheilanthes parryi, Cheilanthes paucijuga, Cheilanthes peninsularis, Cheilanthes persica, Cheilanthes pinnatifida, Cheilanthes praetermissa, Cheilanthes prenticei, Cheilanthes pringlei, Cheilanthes pseudovellea, Cheilanthes pteroides, Cheilanthes pulchella, Cheilanthes pumilio, Cheilanthes sciadioides, Cheilanthes sieberi Kunze, Cheilanthes tenuifolia, Cheilanthes tinaei, Cheilanthes tomentosa, Cheilanthes vellea, Cheilanthes villosa, Cheilanthes viscida, Cheilanthes wootonii, Cheilanthes wrightii,* and *Cheilanthes yavapensis.*

In some embodiments, the IPD113 polypeptide is derived from a fern species in the *Pteridium* Genus selected from, but not limited to, *Pteridium aquilinum, Pteridium arachnoideum, Pteridium brownseyi, Pteridium campestris, Pteridium capense, Pteridium caudatum, Pteridium cehenginense, Pteridium centrali-africanum, Pteridium esculentum, Pteridium falcatum, Pteridium feei, Pteridium heredia, Pteridium lanuginosum, Pteridium latiusculum, Pteridium linea, Pteridium pinetorum, Pteridium psittacinum, Pteridium revolutum, Pteridium semihastatum, Pteridium tauricum, Pteridium yarrabense,* and *Pteridium yunnanense.*

In some embodiments, the IPD113 polypeptide is derived from a fern species in the *Christella* Genus selected from, but not limited to, *Christella arida, Christella augescens, Christella calvescens, Christella crinipes, Christella dentata, Christella hispidula, Christella latipinna, Christella molliuscula, Christella papilio, Christella parasitica, Christella procurrens, Christella scaberula, Christella* sp. 097, *Christella* sp. 2257, and *Christella subulata.*

In some embodiments, the IPD113 polypeptide is derived from a fern species in the *Lastreopsis* Genus selected from, but not limited to, *Lastreopsis acuminata, Lastreopsis acuta, Lastreopsis amplissima, Lastreopsis barteriana, Lastreopsis boivinii, Lastreopsis currori, Lastreopsis decomposita, Lastreopsis effusa, Lastreopsis exculta, Lastreopsis glabella, Lastreopsis hispida, Lastreopsis killipii, Lastreopsis marginans, Lastreopsis microsora, Lastreopsis munita, Lastreopsis nigritiana, Lastreopsis perrieriana, Lastreopsis pseudoperrieriana, Lastreopsis rufescens, Lastreopsis silvestris, Lastreopsis smithiana, Lastreopsis* sp. Kessler 1434, *Lastreopsis subrecedens, Lastreopsis subsericea, Lastreopsis subsimilis, Lastreopsis tenera, Lastreopsis tinarooensis,*

*Lastreopsis vogelii, Lastreopsis walleri, Lastreopsis windsorensis*, and *Lastreopsis wurunuran*.

In some embodiments, the IPD113 polypeptide is derived from a fern species in the *Campyloneurum* Genus selected from, but not limited to, *Campyloneurum abruptum, Campyloneurum aglaolepis, Campyloneurum amphostemon, Campyloneurum anetioides, Campyloneurum angustifolium, Campyloneurum angustipaleatum, Campyloneurum aphanophlebium, Campyloneurum asplundii, Campyloneurum austrobrasilianum, Campyloneurum brevifolium, Campyloneurum centrobrasilianum, Campyloneurum chlorolepis, Campyloneurum coarctatum, Campyloneurum cochense, Campyloneurum costatum, Campyloneurum decurrens, Campyloneurum densifolium, Campyloneurum falcoideum, Campyloneurum fasciale, Campyloneurum fuscosquamatum, Campyloneurum herbaceum, Campyloneurum inflatum, Campyloneurum lapathifolium, Campyloneurum lorentzii, Campyloneurum magnificum Moore, Campyloneurum major, Campyloneurum nitidissimum, Campyloneurum oellgaardi, Campyloneurum ophiocaulon, Campyloneurum oxypholis, Campyloneurum pascoense, Campyloneurum phyllitidis, Campyloneurum repens, Campyloneurum rigidum, Campyloneurum solutum, Campyloneurum sphenodes, Campyloneurum sublucidum, Campyloneurum tenuipes, Campyloneurum tucumanense, Campyloneurum vexatum, Campyloneurum vulpinum, Campyloneurum wacketii, Campyloneurum wurdackii*, and *Campyloneurum xalapense*.

In some embodiments, the IPD113 polypeptide is derived from a fern species in the *Hemionitis* Genus selected from, but not limited to, *Hemionitis acrosticha, Hemionitis acrostichoides, Hemionitis alismifolia, Hemionitis argentea, Hemionitis arifolia, Hemionitis asplenioides, Hemionitis aurea, Hemionitis aureo-nitens, Hemionitis bipinnata, Hemionitis blumeana, Hemionitis boryanum, Hemionitis brasiliana, Hemionitis cajenensis, Hemionitis callifolia, Hemionitis chaerophylla, Hemionitis citrifolia, Hemionitis concava, Hemionitis cordata, Hemionitis cordifolia, Hemionitis coriacea, Hemionitis cumingiana, Hemionitis dealbata, Hemionitis discolor, Hemionitis elegans, Hemionitis elongata, Hemionitis esculenta, Hemionitis falcata, Hemionitis gigantea, Hemionitis grandifolia, Hemionitis griffithii, Hemionitis gymnopteroidea, Hemionitis hastata, Hemionitis hederifolia, Hemionitis hookeriana, Hemionitis hosei, Hemionitis humilis, Hemionitis immersa, Hemionitis incisa, Hemionitis intermedia, Hemionitis japonica, Hemionitis lanceolata, Hemionitis latifolia, Hemionitis leptophylla, Hemionitis lessonii, Hemionitis levyi, Hemionitis lineata, Hemionitis maingayi, Hemionitis muelleri, Hemionitis obtusa, Hemionitis opaca, Hemionitis otonis, Hemionitis palmata, Hemionitis parasitica, Hemionitis parvula, Hemionitis pedata, Hemionitis pedatifida, Hemionitis pinnata, Hemionitis pinnatifida, Hemionitis plantaginea, Hemionitis podophylla, Hemionitis polypodioides, Hemionitis pothifolia, Hemionitis pozoi, Hemionitis prolifera, Hemionitis reinwardtiana, Hemionitis reticulata, Hemionitis rigida, Hemionitis rufa, Hemionitis sagittata, Hemionitis semicostata, Hemionitis sessilifolia, Hemionitis×smithii, Hemionitis spatulata, Hemionitis stipitata, Hemionitis subcordata, Hemionitis tomentosa, Hemionitis toxotis, Hemionitis triloba, Hemionitis trinervis, Hemionitis vestita, Hemionitis vittaeformis, Hemionitis wilfordii*, and *Hemionitis zollingeri*.

In some embodiments, the IPD113 polypeptide is derived from a fern species in the *Selliguea* Genus selected from, but not limited to, *Selliguea albicaula, Selliguea albidopaleata, Selliguea albidosquamata, Selliguea albopes, Selliguea archboldii, Selliguea bakeri, Selliguea balbi, Selliguea banaensis, Selliguea bellisquamata, Selliguea bisulcata, Selliguea brooksii, Selliguea caudiformis, Selliguea ceratophylla, Selliguea chenkouensis, Selliguea chinensis, Selliguea chrysotricha, Selliguea conjuncts, Selliguea connexa, Selliguea costulata, Selliguea craspedosora, Selliguea crenatopinnata, Selliguea cretifera, Selliguea cruciformis, Selliguea cunea, Selliguea dactylina, Selliguea dekockii, Selliguea digitata, Selliguea ebenipes, Selliguea echinospora, Selliguea elmeri, Selliguea enervis, Selliguea engleri, Selliguea erythrocarpa, Selliguea feel, Selliguea feeoides, Selliguea ferrea, Selliguea fukienensis, Selliguea glauca, Selliguea glaucopsis, Selliguea gracilipes, Selliguea griffithiana, Selliguea hainanensis, Selliguea hastata, Selliguea hellwigii, Selliguea heterocarpa, Selliguea hirsuta, Selliguea hirtella, Selliguea hunyaensis, Selliguea integerrima, Selliguea katuii, Selliguea kingpingensis, Selliguea kwangtungensis, Selliguea laciniata, Selliguea lagunensis, Selliguea laipoensis, Selliguea lancea, Selliguea lanceola, Selliguea lateritia, Selliguea lauterbachii, Selliguea likiangensis, Selliguea majoensis, Selliguea malacodon, Selliguea metacoela, Selliguea montana, Selliguea murudensis, Selliguea neglecta, Selliguea nigropaleacea, Selliguea nigrovenia, Selliguea oblongifolia, Selliguea obtusa, Selliguea omeiensis, Selliguea oodes, Selliguea oxyloba, Selliguea palmatifida, Selliguea pampylocarpa, Selliguea pellucidifolia, Selliguea pianmaensis, Selliguea pingpienensis, Selliguea plantaginea, Selliguea platyphylla, Selliguea pseudoacrosticha, Selliguea pyrolifolia, Selliguea quasidivaricata, Selliguea rhynchophylla, Selliguea rigida, Selliguea roseomarginata, Selliguea rotunda, Selliguea setacea, Selliguea shandongensis, Selliguea shensiensis, Selliguea similis, Selliguea simplicifolia, Selliguea simplicissima, Selliguea soridens, Selliguea sri-ratu, Selliguea stenophylla, Selliguea stenosquamis, Selliguea stewartii, Selliguea suboxyloba, Selliguea subsparsa, Selliguea subtaeniata, Selliguea taeniata, Selliguea tafana, Selliguea taiwanensis, Selliguea tamdaoensis, Selliguea tarningensis, Selliguea tenuipes, Selliguea tibetana, Selliguea triloba, Selliguea triquetra, Selliguea violascens, Selliguea waltonii, Selliguea whitfordii, Selliguea wuliangshanensis, Selliguea wuyishanica, Selliguea yakuinsularis*, and *Selliguea yakushimensis*.

In some embodiments, the IPD113 polypeptide is derived from a fern species in the *Arachniodes* Genus selected from, but not limited to, *Arachniodes abrupta, Arachniodes acuminata, Arachniodes ailaoshanensis, Arachniodes amabilis, Arachniodes amoena, Arachniodes anshunensis, Arachniodes argillicola, Arachniodes arisanica, Arachniodes aristata, Arachniodes aristatissima, Arachniodes aspidioides, Arachniodes assamica, Arachniodes attenuata, Arachniodes australis, Arachniodes austro-yunnanensis, Arachniodes×azuminoensis, Arachniodes baiseensis, Arachniodes basipinnata, Arachniodes bella, Arachniodes bipinnata, Arachniodes blinii, Arachniodes borealis, Arachniodes calcarata, Arachniodes cantilenae, Arachniodes carvifolia, Arachniodes caudata, Arachniodes caudifolia, Arachniodes cavalerii, Arachniodes centrochinensis, Arachniodes chaerophylloides, Arachniodes chinensis, Arachniodes ii, Arachniodes clivorum, Arachniodes coadnata, Arachniodes coniifolia, Arachniodes cornopteris, Arachniodes comucervi, Arachniodes costulisora, Arachniodes cyrtomifolia, Arachniodes damiaoshanensis, Arachniodes davalliaeformis, Arachniodes dayaoensis, Arachniodes decomposita, Arachniodes denticulata, Arachniodes denticulata, Arachniodes denticulatabarbensis, Arachniodes denticulatajucunda, Arachniodes diffracta, Arachniodes dimorphophyllum, Arachniodes duplicatoserrata, Arachniodes elevatas, Arachniodes emeiensis, Arachniodes erythrosora, Arach-* niodes exilis, *Arachniodes falcata, Arachniodes fengii, Arachniodes fengyangshanensis, Arachniodes festina, Arachniodes foeniculacea, Arachniodes foliosa, Arachniodes formosa, Arachniodes formosissima, Arachniodes fujianensis, Arachniodes futeshanensis, Arachniodes gansuensis, Arachniodes gigantea, Arachniodes gijiangensis, Arachniodes gizushanensis, Arachniodes globisora, Arachniodes gongshanensis, Arachniodes gradata, Arachniodes grossa, Arachniodes guangnanensis, Arachniodes guangtongensis, Arachniodes guangxiensis, Arachniodes guanxianensis, Arachniodes hainanensis, Arachniodes haniffii, Arachniodes hasseltii, Arachniodes hekiana, Arachniodes hekouensis, Arachniodes henryi, Arachniodes heyuanensis, Arachniodes hiugana, Arachniodes holttumii, Arachniodes huapingensis, Arachniodes hunanensis, Arachniodes hupingshanensis, Arachniodes×ikeminensis, Arachniodes insularis, Arachniodes intermedia, Arachniodes ishingensis, Arachniodes japonica, Arachniodes jiangxiensis, Arachniodes jinfoshanensis, Arachniodes jingdongensis, Arachniodes jinpingensis, Arachniodes jiulongshanensis, Arachniodes kansuensis, Arachniodes kenzo-satakei, Arachniodes kurosawae, Arachniodes kweichowensis, Arachniodes lanceolata, Arachniodes leuconeura, Arachniodes leucostegioides, Arachniodes liyangensis, Arachniodes longipinna, Arachniodes lurida, Arachniodes lushanensis, Arachniodes lushuiensis, Arachniodes macrocarpa, Arachniodes macrostegia, Arachniodes macrostegia, Arachniodes maguanensis, Arachniodes maoshanensis, Arachniodes masakii, Arachniodes maxima, Arachniodes maximowiczii, Arachniodes maximowiczii, Arachniodes menglianensis, Arachniodes mengziensis, Arachniodes michelii, Arachniodes minamitanii, Arachniodes miqueliana, Arachniodes mirabilis, Arachniodes×mitsuyoshiana, Arachniodes multifida, Arachniodes mutica, Arachniodes nanchuanensis, Arachniodes nanqingensis, Arachniodes neoaristata, Arachniodes neobipinnata, Arachniodes neofalcata, Arachniodes neohunanensis, Arachniodes neopodophylla, Arachniodes nibashanensis, Arachniodes nigrospinosa, Arachniodes nipponica, Arachniodes nitidula, Arachniodes obtusiloba, Arachniodes obtusipinnula, Arachniodes obtusissima, Arachniodes ochropteroides, Arachniodes okinawensis, Arachniodes oohorae, Arachniodes palmipes, Arachniodes parasimplicior, Arachniodes pianmaensis, Arachniodes pinnatifida, Arachniodes pseudo-assamica, Arachniodes pseudo-longipinna, Arachniodes pseudo-repens, Arachniodes pseudo-simplicior, Arachniodes pseudoaristata, Arachniodes pseudocavalerii, Arachniodes×pseudohekiana, Arachniodes pubescens, Arachniodes puncticulata, Arachniodes quadripinnata, Arachniodes reducta, Arachniodes repens, Arachniodes respiciens, Arachniodes×respiciens, Arachniodes rhomboidea, Arachniodes rhomboidearhomboidea, Arachniodes rigidissima, Arachniodes sarasiniorum, Arachniodes sasamotoi, Arachniodes semifertilis, Arachniodes setifera, Arachniodes shuangbaiensis, Arachniodes sichuanensis, Arachniodes similis, Arachniodes simplicior, Arachniodes simulans, Arachniodes sino-aristata, Arachniodes sino-rhomboidea, Arachniodes sinomiqueliana, Arachniodes sledgei, Arachniodes sparsa, Arachniodes speciosa, Arachniodes spectabilis, Arachniodes sphaerosora, Arachniodes spino-serrulata, Arachniodes sporadosora, Arachniodes squamulosa, Arachniodes standishii, Arachniodes subamabilis, Arachniodes subamoena, Arachniodes subaristata, Arachniodes subreflexipinna, Arachniodes suijiangensis, Arachniodes superba, Arachniodes× takayamensis, Arachniodes tibetana, Arachniodes tiendongensis, Arachniodes tomitae, Arachniodes tonkinensis, Arachniodes triangularis, Arachniodes tripinnata, Arachniodes tsiangiana, Arachniodes valida, Arachniodes walkerae, Arachniodes webbiana, Arachniodes wulingshanensis, Arachniodes xinpingensis, Arachniodes yakusimensis, Arachniodes yandangshanensis, Arachniodes yaomashanensis, Arachniodes yaoshanensis, Arachniodes yasuinouei, Arachniodes yinjiangensis, Arachniodes yixinensis, Arachniodes yoshinagae, Arachniodes yunnanensis, Arachniodes yunqiensis, Arachniodes zeylanica*, and *Arachniodes ziyunshanensis*.

"Sufficiently homologous" is used herein to refer to an amino acid sequence that has at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence homology compared to a reference sequence using one of the alignment programs described herein using standard parameters. In some embodiments, the sequence homology is against the full-length sequence of an IPD113 polypeptide.

In some embodiments, the IPD113 polypeptide has at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494, and SEQ ID NO: 495, as well as amino acid substitutions, deletions, insertions, fragments thereof, and combinations thereof.

In some embodiments, the IPD113 polypeptide has at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494, and SEQ ID NO: 495 and has at least one amino acid substitution, deletion, insertion or combination therefore compared to the native sequence.

In another aspect IPD113 polypeptides are encompassed. Also provided are isolated or recombinant IPD113 polypeptides of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494, or SEQ ID NO: 495. The term "about" when used herein in context with percent sequence identity means+/−0.5%. One of skill in the art will recognize that these values can be appropriately adjusted to determine corresponding homology of proteins considering amino acid similarity and the like.

In some embodiments, the sequence identity is calculated using ClustalW algorithm in the ALIGNX® module of the Vector NTI® Program Suite (Invitrogen Corporation, Carlsbad, Calif.) with all default parameters. In some embodiments, the sequence identity is across the entire length of polypeptide calculated using ClustalW algorithm in the ALIGNX® module of the Vector NTI® Program Suite (Invitrogen Corporation, Carlsbad, Calif.) with all default parameters.

As used herein, the terms "protein," "peptide molecule," or "polypeptide" includes any molecule that comprises five or more amino acids. Protein, peptide or polypeptide molecules may undergo modification, including post-translational modifications, such as, but not limited to, disulfide bond formation, glycosylation, phosphorylation or oligomerization. Thus, as used herein, the terms "protein," "peptide molecule" or "polypeptide" includes any protein that is modified by any biological or non-biological process. The terms "amino acid" and "amino acids" refer to all naturally occurring L-amino acids.

A "recombinant protein" is used herein to refer to a protein that is no longer in its natural environment, for example in vitro or in a recombinant bacterial or plant host cell. An IPD113 polypeptide that is substantially free of cellular material includes preparations of protein having less than about 30%, 20%, 10% or 5% (by dry weight) of non-pesticidal protein (also referred to herein as a "contaminating protein").

"Fragments" or "biologically active portions" include polypeptide fragments comprising amino acid sequences sufficiently identical to an IPD113 polypeptide and that exhibit insecticidal activity. "Fragments" or "biologically active portions" of IPD113 polypeptides includes fragments comprising amino acid sequences sufficiently identical to the amino acid sequence set forth in IPD113 polypeptides of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO:

489, SEQ ID NO: 490, SEQ ID NO: 491, SEQ ID NO: 492, SEQ ID NO: 494, or SEQ ID NO: 495, wherein the polypeptide has insecticidal activity. Such biologically active portions can be prepared by recombinant techniques and evaluated for insecticidal activity. In some embodiments, the IPD113 polypeptide fragment is an N-terminal and/or a C-terminal truncation of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31 or more amino acids from the N-terminus and/or C-terminus relative to IPD113 polypeptides of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 32, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495, e.g., by proteolysis, by insertion of a start codon, by deletion of the codons encoding the deleted amino acids and concomitant insertion of a start codon, and/or insertion of a stop codon.

In some embodiments, the IPD113 polypeptide fragment is an N-terminal truncation of at least 1, 2, 3, 4, 5, 6, 7, 8, 9, 10, 11, 12, 13, 14, 15, 16, 17, 18, 19, 20, 21, 22, 23, 24 amino acids from the N-terminus of IPD113 polypeptides of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494, or SEQ ID NO: 495.

In some embodiments, the IPD113 polypeptide fragment is an N-terminal and/or a C-terminal truncation of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34 or more amino acids from the N-terminus and/or C-terminus relative to IPD113 polypeptides of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495.

"Variants" as used herein refers to proteins or polypeptides having an amino acid sequence that is at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater identical to the parental amino acid sequence.

In some embodiments, an IPD113 polypeptide comprises an amino acid sequence having at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity to the amino acid sequence of IPD113 polypeptides of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495, wherein the IPD113 polypeptide has insecticidal activity.

In some embodiments, an IPD113 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of the IPD113 polypeptide of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319 or SEQ ID NO: 320.

In some embodiments, the sequence identity is across the entire length of the polypeptide calculated using ClustalW algorithm in the ALIGNX® module of the Vector NTI® Program Suite (Invitrogen Corporation, Carlsbad, Calif.) with all default parameters.

In some embodiments, the IPD113 polypeptide comprises an amino acid sequence having at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 27, SEQ ID NO: 30, SEQ ID NO: 35, SEQ ID NO: 36, SEQ ID NO: 37, SEQ ID NO: 38, SEQ ID NO: 77, SEQ ID NO: 88, SEQ ID NO: 89, SEQ ID NO: 90, SEQ ID NO: 91, SEQ ID NO: 93, SEQ ID NO: 94, SEQ ID NO: 95, SEQ ID NO: 96, SEQ ID NO: 97, SEQ ID NO: 98, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 110, SEQ ID NO: 111, SEQ ID NO: 112, SEQ ID NO: 113 or SEQ ID NO: 114.

In some embodiments, the IPD113 polypeptide comprises an amino acid sequence having at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 24, SEQ ID NO: 93, SEQ ID NO: 94, SEQ ID NO: 95, SEQ ID NO: 96, SEQ ID NO: 103, SEQ ID NO: 104, SEQ ID NO: 105, SEQ ID NO: 106, SEQ ID NO: 107, SEQ ID NO: 39 or SEQ ID NO: 40.

In some embodiments, the IPD113 polypeptide comprises an amino acid sequence having at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 88, SEQ ID NO: 89, SEQ ID NO: 90 or SEQ ID NO: 91.

In some embodiments, the IPD113 polypeptide comprises an amino acid sequence having at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 20, SEQ ID NO: 24 or SEQ ID NO: 27.

In some embodiments, the IPD113 polypeptide comprises an amino acid sequence having at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 13, SEQ ID NO: 14, SEQ ID NO: 15, SEQ ID NO: 21 or SEQ ID NO: 22.

In some embodiments, the IPD113 polypeptide comprises an amino acid sequence having at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 17, SEQ ID NO: 18, SEQ ID NO: 19, SEQ ID NO: 38, SEQ ID NO: 77, SEQ ID NO: 110, SEQ ID NO: 111 or SEQ ID NO: 112.

In some embodiments, the IPD113 polypeptide comprises an amino acid sequence having at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 9, SEQ ID NO: 10, SEQ ID NO: 11, SEQ ID NO: 12, SEQ ID NO: 16, SEQ ID NO: 23, SEQ ID NO: 35, SEQ ID NO: 36, SEQ ID NO: 37, SEQ ID NO: 97, SEQ ID NO: 98, SEQ ID NO: 100, SEQ ID NO: 101, SEQ ID NO: 102, SEQ ID NO: 113 or SEQ ID NO: 114.

In some embodiments, the IPD113 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 10.

In some embodiments, the IPD113 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 16.

In some embodiments, an IPD113 polypeptide comprises an amino acid sequence of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35 or more amino acid substitutions, deletions and/or insertions compared to the native amino acid at the corresponding position of IPD113 polypeptides of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495.

Methods for such manipulations of an IPD113 polypeptide can be prepared by mutations in the DNA. This may also be accomplished by one of several forms of mutagenesis and/or in directed evolution.

In some aspects, the changes encoded in the amino acid sequence will not substantially affect the function of the protein. Such variants will possess the desired pesticidal activity. However, it is understood that the ability of an IPD113 polypeptide to confer pesticidal activity may be improved using such techniques upon the compositions of this disclosure.

For example, conservative amino acid substitutions may be made at one or more predicted nonessential amino acid residues. A "nonessential" amino acid residue is a residue that can be altered from the wild-type sequence of an IPD113 polypeptide without altering the biological activity. Alignment of the amino acid sequences of IPD113 polypeptide homologs (for example—FIGS. 2, 3, and 4), allows for the identification of residues that are highly conserved amongst the natural homologs of this family as well as residues or regions tolerant to amino acid diversity. A "conservative amino acid substitution" is one in which the amino acid residue is replaced with an amino acid residue having a similar side chain. Families of amino acid residues having similar side chains have been defined in the art. These families include: amino acids with basic side chains (e.g., lysine, arginine, histidine); acidic side chains (e.g., aspartic acid, glutamic acid); polar, negatively charged residues and their amides (e.g., aspartic acid, asparagine, glutamic, acid, glutamine; uncharged polar side chains (e.g., glycine, asparagine, glutamine, serine, threonine, tyrosine, cysteine); small aliphatic, nonpolar or slightly polar residues (e.g., Alanine, serine, threonine, proline, glycine); nonpolar side chains (e.g., alanine, valine, leucine, isoleucine, proline, phenylalanine, methionine, tryptophan); large aliphatic, nonpolar residues (e.g., methionine, leucine, isoleucine, valine, cystine); beta-branched side chains (e.g., threonine, valine, isoleucine); aromatic side chains (e.g., tyrosine, phenylalanine, tryptophan, histidine); large aromatic side chains (e.g., tyrosine, phenylalanine, tryptophan).

Amino acid substitutions may be made in nonconserved regions that retain function. In general, such substitutions would not be made for conserved amino acid residues or for amino acid residues residing within a conserved motif, where such residues are essential for protein activity. Examples of residues that are conserved and that may be essential for protein activity include, for example, residues that are identical between all proteins contained in an alignment of similar or related toxins to the sequences of the embodiments (e.g., residues that are identical in an alignment of homologous proteins). Examples of residues that are conserved but that may allow conservative amino acid substitutions and still retain activity include, for example, residues that have only conservative substitutions between all proteins contained in an alignment of similar or related toxins to the sequences of the embodiments (e.g., residues that have only conservative substitutions between all proteins contained in the alignment homologous proteins). However, one of skill in the art would understand that functional variants may have minor conserved or nonconserved alterations in the conserved residues. Guidance as to appropriate amino acid substitutions that do not affect biological activity of the protein of interest may be found in the model of Dayhoff, et al., (1978) *Atlas of Protein Sequence and Structure* (Natl. Biomed. Res. Found., Washington, D.C.), herein incorporated by reference.

In making such changes, the hydropathic index of amino acids may be considered. The importance of the hydropathic amino acid index in conferring interactive biologic function on a protein is generally understood in the art (Kyte and Doolittle, (1982) *J Mol Biol.* 157(1):105-32). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

Certain amino acids may be substituted by other amino acids having a similar hydropathic index or score and still result in a protein with similar biological activity, i.e., still obtain a biological functionally equivalent protein. Each amino acid has been assigned a hydropathic index based on its hydrophobicity and charge characteristics (Kyte and Doolittle, ibid). These are: isoleucine (+4.5); valine (+4.2);

leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9) and arginine (−4.5). In making such changes, the substitution of amino acids whose hydropathic indices are within +2 is preferred, those which are within +1 are particularly preferred, and those within +0.5 are even more particularly preferred.

It is also understood that the substitution of like amino acids can be made effectively based on hydrophilicity. U.S. Pat. No. 4,554,101, states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0.+ 0.1); glutamate (+3.0.+0.1); serine (+0.3); asparagine (+0.2); glutamine (+0.2); glycine (0); threonine (−0.4); proline (−0.5.+0.1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4).

Alternatively, alterations may be made to the protein sequence of many proteins at the amino or carboxy terminus without substantially affecting activity. This can include insertions, deletions or alterations introduced by modern molecular methods, such as PCR, including PCR amplifications that alter or extend the protein coding sequence by inclusion of amino acid encoding sequences in the oligonucleotides utilized in the PCR amplification. Alternatively, the protein sequences added can include entire protein-coding sequences, such as those used commonly in the art to generate protein fusions. Such fusion proteins are often used to (1) increase expression of a protein of interest (2) introduce a binding domain, enzymatic activity or epitope to facilitate either protein purification, protein detection or other experimental uses (3) target secretion or translation of a protein to a subcellular organelle, such as the periplasmic space of Gram-negative bacteria, mitochondria or chloroplasts of plants or the endoplasmic reticulum of eukaryotic cells, the latter of which often results in glycosylation of the protein.

Variant nucleotide and amino acid sequences of the disclosure also encompass sequences derived from mutagenic and recombinogenic procedures such as DNA shuffling. With such a procedure, one or more different IPD113 polypeptide coding regions can be used to create a new IPD113 polypeptide possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between a pesticidal gene and other known pesticidal genes to obtain a new gene coding for a protein with an improved property of interest, such as an increased insecticidal activity. Strategies for such DNA shuffling include Stemmer, (1994) *Proc. Natl. Acad. Sci. USA* 91:10747-10751; Stemmer, (1994) *Nature* 370:389-391; Crameri, et al., (1997) *Nature Biotech.* 15:436-438; Moore, et al., (1997) *J. Mol. Biol.* 272:336-347; Zhang, et al., (1997) *Proc. Natl. Acad. Sci. USA* 94:4504-4509; Crameri, et al., (1998) *Nature* 391:288-291; and U.S. Pat. Nos. 5,605,793 and 5,837,458.

Domain swapping or shuffling is another mechanism for generating altered IPD113 polypeptides. Domains may be swapped between IPD113 polypeptides resulting in hybrid or chimeric toxins with improved insecticidal activity or target spectrum. Methods for generating recombinant proteins and testing them for pesticidal activity (see, for example, Naimov, et al., (2001) *Appl. Environ. Microbiol.* 67:5328-5330; de Maagd, et al., (1996) *Appl. Environ. Microbiol.* 62:1537-1543; Ge, et al., (1991) *J. Biol. Chem.* 266:17954-17958; Schnepf, et al., (1990) *J. Biol. Chem.* 265:20923-20930; Rang, et al., 91999) *Appl. Environ. Microbiol.* 65:2918-2925).

Phylogenetic, sequence motif, and structural analyses of insecticidal protein families. A sequence and structure analysis method can be employed, which is composed of four components: phylogenetic tree construction, protein sequence motifs finding, secondary structure prediction, and alignment of protein sequences and secondary structures. Details about each component are illustrated below.

1) Phylogenetic Tree Construction

The phylogenetic analysis can be performed using the software MEGA5. Protein sequences can be subjected to ClustalW version 2 analysis (Larkin M. A et al (2007) *Bioinformatics* 23(21): 2947-2948) for multiple sequence alignment. The evolutionary history is then inferred by the Maximum Likelihood method based on the JTT matrix-based model. The tree with the highest log likelihood is obtained, exported in Newick format, and further processed to extract the sequence IDs in the same order as they appeared in the tree. A few clades representing sub-families can be manually identified for each insecticidal protein family.

2) Protein Sequence Motifs Finding

Protein sequences are re-ordered according to the phylogenetic tree built previously, and fed to the MOTIF analysis tool MEME (Multiple EM for MOTIF Elicitation) (Bailey T. L., and Elkan C., *Proceedings of the Second International Conference on Intelligent Systems for Molecular Biology*, pp. 28-36, AAAI Press, Menlo Park, Calif., 1994.) for identification of key sequence motifs. MEME is setup as follows: Minimum number of sites 2, Minimum motif width 5, and Maximum number of motifs 30. Sequence motifs unique to each sub-family were identified by visual observation. The distribution of MOTIFs across the entire gene family could be visualized in HTML webpage. The MOTIFs are numbered relative to the ranking of the E-value for each MOTIF.

3) Secondary Structure Prediction

PSIPRED, top ranked secondary structure prediction method (Jones D T. (1999) *J. Mol. Biol.* 292: 195-202), can be used for protein secondary structure prediction. The tool provides accurate structure prediction using two feed-forward neural networks based on the PSI-BLAST output. The PSI-BLAST database is created by removing low-complexity, transmembrane, and coiled-coil regions in Uniref100. The PSIPRED results contain the predicted secondary structures (Alpha helix: H, Beta strand: E, and Coil: C) and the corresponding confidence scores for each amino acid in a given protein sequence.

4) Alignment of Protein Sequences and Secondary Structures

A script can be developed to generate gapped secondary structure alignment according to the multiple protein sequence alignment from step 1 for all proteins. All aligned protein sequences and structures are concatenated into a single FASTA file, and then imported into MEGA for visualization and identification of conserved structures.

In some embodiments, the IPD113 polypeptide has a modified physical property. As used herein, the term "physical property" refers to any parameter suitable for describing the physical-chemical characteristics of a protein. As used herein, "physical property of interest" and "property of interest" are used interchangeably to refer to physical properties of proteins that are being investigated and/or modified. Examples of physical properties include, but are not limited to, net surface charge and charge distribution on the protein surface, net hydrophobicity and hydrophobic residue distribution on the protein surface, surface charge density, surface hydrophobicity density, total count of surface ionizable groups, surface tension, protein size and its distribution in solution, melting temperature, heat capacity, and second virial coefficient. Examples of physical properties also include, IPD113 polypeptide having increased expression, increased solubility, decreased phytotoxicity, and digestibility of proteolytic fragments in an insect gut. Models for digestion by simulated gastric fluids include those of Fuchs, R. L. and J. D. Astwood. Food Technology 50: 83-88, 1996; Astwood, J. D., et al *Nature Biotechnology* 14: 1269-1273, 1996; Fu T J et al *J. Agric Food Chem.* 50: 7154-7160, 2002.

In some embodiments, variants include polypeptides that differ in amino acid sequence due to mutagenesis. Variant proteins encompassed by the disclosure are biologically active, that is they continue to possess the desired biological activity (i.e. pesticidal activity) of the native protein. In some embodiment, the variant will have at least about 10%, at least about 30%, at least about 50%, at least about 70%, at least about 80% or more of the insecticidal activity of the native protein. In some embodiments, the variants may have improved activity over the native protein.

Bacterial genes quite often possess multiple methionine initiation codons in proximity to the start of the open reading frame. Often, translation initiation at one or more of these start codons will lead to generation of a functional protein. These start codons can include ATG codons. However, bacteria such as *Bacillus* sp. also recognize the codon GTG as a start codon, and proteins that initiate translation at GTG codons contain a methionine at the first amino acid. On rare occasions, translation in bacterial systems can initiate at a TTG codon, though in this event the TTG encodes a methionine. Furthermore, it is not often determined a priori which of these codons are used naturally in the bacterium. Thus, it is understood that use of one of the alternate methionine codons may also lead to generation of pesticidal proteins. These pesticidal proteins are encompassed in the present disclosure and may be used in the methods of the present disclosure. It will be understood that, when expressed in plants, it will be necessary to alter the alternate start codon to ATG for proper translation.

One skilled in the art understands that the polynucleotide coding sequence can be modified to add a codon at the penultimate position following the methionine start codon to create a restriction enzyme site for recombinant cloning purposes and/or for expression purposes. In some embodiments, the IPD113 polypeptide further comprises an alanine residue at the position after the translation initiator methionine.

In some embodiments, the translation initiator methionine of the IPD113 polypeptide is cleaved off post translationally. One skilled in the art understands that the N-terminal translation initiator methionine can be removed by methionine aminopeptidase in many cellular expression systems.

In some embodiments, the IPD113 polypeptide comprises the amino acid sequence of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495.

In some embodiments, chimeric polypeptides are provided comprising regions of at least two different IPD113 polypeptides of the disclosure.

In some embodiments, chimeric polypeptides are provided comprising regions of at least two different IPD113 polypeptides selected from SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495.

In some embodiments, the chimeric insecticidal protein comprises a) a first portion of a continuous stretch of the amino acid sequence of a first recombinant IPD113 polypeptide of the embodiments; and b) a corresponding second portion of a continuous stretch of the amino acid sequence of a second recombinant IPD113 polypeptide of the embodiments. As used herein "corresponding portion" means a part or all the amino acid sequence of the second recombinant IPD113 polypeptide that continues from the end or breakpoint of the portion of the amino acid sequence of the first recombinant IPD113 polypeptide. As used herein, "breakpoint" means the transition point between the two IPD113 popeptide sequences. For example, if the first and second IPD113 polypeptide are about three hundred amino acids in length and the first portion includes amino acids 1 to about 175 from the first IPD113 polypeptide and the corresponding second portion comprises amino acids about amino acids 176 to about 300 from the second IPD113 polypeptide. It is understood that the two sequences may vary in length so the residue numbering may not be the same between the two sequences. An amino acid sequence alignment between two or more IPD113 polypeptides can be used to determine the correspondence between the numbering of the residues of the polypeptide sequences. A breakpont can be selected based on but not limited to: 1) shared regions of sequence between the two IPD113 polypeptides; 2) between shared domains or motifs; or 3) between shared secondary or tertiary structural elements. The occurrence of sequences within regions that are known to be involved in periodic secondary structure (alpha and 3-10 helices, parallel and anti-parallel beta sheets) are regions that should be avoided. Similarly, regions of amino acid sequence that are observed or predicted to have a low degree of solvent exposure are more likely to be part of the so-called hydrophobic core of the protein and should also be avoided for selection of the breakpoint. In contrast, those regions that are known or predicted to be in surface turns or loops, and especially those regions that are known not to be required for biological activity, are the preferred sites for location of the breakpoint. Continuous stretches of amino acid sequence that are preferred based on the above criteria are referred to as a "breakpoint region".

In some embodiments, chimeric IPD113 polypeptide are provided comprising an N-terminal Region of a first IPD113 polypeptide of the disclosure operably fused to a C-terminal Region of a second IPD113 polypeptide of the disclosure.

In other embodiments, the IPD113 polypeptide may be expressed as a precursor protein with an intervening sequence that catalyzes multi-step, post translational protein splicing. Protein splicing involves the excision of an intervening sequence from a polypeptide with the concomitant joining of the flanking sequences to yield a new polypeptide (Chong, et al., (1996) *J. Biol. Chem.*, 271:22159-22168). This intervening sequence or protein splicing element, referred to as inteins, which catalyze their own excision through three coordinated reactions at the N-terminal and C-terminal splice junctions: an acyl rearrangement of the N-terminal cysteine or serine; a transesterfication reaction between the two termini to form a branched ester or thioester intermediate and peptide bond cleavage coupled to cyclization of the intein C-terminal asparagine to free the intein (Evans, et al., (2000) *J. Biol. Chem.*, 275:9091-9094. The elucidation of the mechanism of protein splicing has led to a number of intein-based applications (Comb, et al., U.S. Pat. No. 5,496,714; Comb, et al., U.S. Pat. No. 5,834,247; Camarero and Muir, (1999) *J. Amer. Chem. Soc.* 121:5597-5598; Chong, et al., (1997) *Gene* 192:271-281, Chong, et al., (1998) *Nucleic Acids Res.* 26:5109-5115; Chong, et al., (1998) *J. Biol. Chem.* 273:10567-10577; Cotton, et al., (1999) *J. Am. Chem. Soc.* 121:1100-1101; Evans, et al., (1999) *J. Biol. Chem.* 274:18359-18363; Evans, et al., (1999) *J. Biol. Chem.* 274:3923-3926; Evans, et al., (1998) *Protein Sci.* 7:2256-2264; Evans, et al., (2000) *J. Biol. Chem.* 275:9091-9094; Iwai and Pluckthun, (1999) *FEBS Lett.* 459:166-172; Mathys, et al., (1999) *Gene* 231:1-13; Mills, et al., (1998) *Proc. Natl. Acad. Sci. USA* 95:3543-3548; Muir, et al., (1998) *Proc. Natl. Acad. Sci. USA* 95:6705-6710; Otomo, et al., (1999) *Biochemistry* 38:16040-16044; Otomo, et al., (1999) *J. Biolmol. NMR* 14:105-114; Scott, et al., (1999) *Proc. Natl. Acad. Sci. USA* 96:13638-13643; Severinov and Muir, (1998) *J. Biol. Chem.* 273:16205-16209; Shingledecker, et al., (1998) *Gene* 207:187-195; Southworth, et al., (1998) *EMBO J.* 17:918-926; Southworth, et al., (1999) *Biotechniques* 27:110-120; Wood, et al., (1999) *Nat. Biotechnol.* 17:889-892; Wu, et al., (1998a) *Proc. Natl. Acad. Sci. USA* 95:9226-9231; Wu, et al., (1998b) *Biochim Biophys Acta* 1387:422-432; Xu, et al., (1999) *Proc. Natl. Acad. Sci. USA* 96:388-393; Yamazaki, et al., (1998) *J. Am. Chem. Soc.*, 120:5591-5592). For the application of inteins in plant transgenes, see, Yang, et al., (*Transgene Res* 15:583-593 (2006)) and Evans, et al., (*Annu. Rev. Plant Biol.* 56:375-392 (2005)).

In another embodiment, the IPD113 polypeptide may be encoded by two separate genes where the intein of the precursor protein comes from the two genes, referred to as a split-intein, and the two portions of the precursor are joined by a peptide bond formation. This peptide bond formation is accomplished by intein-mediated trans-splicing. For this purpose, a first and a second expression cassette comprising the two separate genes further code for inteins capable of mediating protein trans-splicing. By trans-splicing, the proteins and polypeptides encoded by the first and second fragments may be linked by peptide bond formation. Trans-splicing inteins may be selected from the nucleolar and organellar genomes of different organisms including eukaryotes, archaebacteria and eubacteria. Inteins that may be used for are listed at neb.com/neb/inteins.html, which can be accessed on the world-wide web using the "www" prefix). The nucleotide sequence coding for an intein may be split into a 5' and a 3' part that code for the 5' and the 3' part of the intein, respectively. Sequence portions not necessary for intein splicing (e.g. homing endonuclease domain) may be deleted. The intein coding sequence is split such that the 5' and the 3' parts are capable of trans-splicing. For selecting a suitable splitting site of the intein coding sequence, the considerations published by Southworth, et al., (1998) *EMBO J.* 17:918-926 may be followed. In constructing the first and the second expression cassette, the 5' intein coding sequence is linked to the 3' end of the first fragment coding for the N-terminal part of the IPD113 polypeptide and the 3' intein coding sequence is linked to the 5' end of the second fragment coding for the C-terminal part of the IPD113 polypeptide.

In general, the trans-splicing partners can be designed using any split intein, including any naturally-occurring or artificially-split split intein. Several naturally-occurring split inteins are known, for example: the split intein of the DnaE gene of *Synechocystis* sp. PCC6803 (see, Wu, et al., (1998) *Proc Natl Acad Sci USA.* 95(16):9226-31 and Evans, et al., (2000) *J Biol Chem.* 275(13):9091-4 and of the DnaE gene from *Nostoc punctiforme* (see, Iwai, et al., (2006) *FEBS Lett.* 580(7):1853-8). Non-split inteins have been artificially split in the laboratory to create new split inteins, for example: the artificially split Ssp DnaB intein (see, Wu, et al., (1998) *Biochim Biophys Acta.* 1387:422-32) and split Sce VMA intein (see, Brenzel, et al., (2006) *Biochemistry.* 45(6):1571-8) and an artificially split fungal mini-intein (see, Elleuche, et al., (2007) *Biochem Biophys Res Commun.* 355(3):830-4). There are also intein databases available that catalogue known inteins (see for example the online-database available at: bioinformatics.weizmann.ac.ilrpietro/inteins/Intein-stable.html, which can be accessed on the world-wide web using the "www" prefix).

Naturally-occurring non-split inteins may have endonuclease or other enzymatic activities that can typically be removed when designing an artificially-split split intein. Such mini-inteins or minimized split inteins are typically less than 200 amino acid residues long (see, Wu, et al., (1998) *Biochim Biophys Acta.* 1387:422-32). Suitable split inteins may have other purification enabling polypeptide elements added to their structure, if such elements do not inhibit the splicing of the split intein or are added in a manner that allows them to be removed prior to splicing. Protein splicing has been reported using proteins that comprise bacterial intein-like (BIL) domains (see, Amitai, et al., (2003) *Mol Microbiol.* 47:61-73) and hedgehog (Hog) auto-processing domains (the latter is combined with inteins when referred to as the Hog/intein superfamily or HINT family (see, Dassa, et al., (2004) *J Biol Chem.* 279:32001-7) and domains such as these may also be used to prepare artificially-split inteins. In particular, non-splicing members of such families may be modified by molecular biology methodologies to introduce or restore splicing activity in such related species. Recent studies demonstrate that splicing can be observed when a N-terminal split intein component can react with a C-terminal split intein component not found in nature to be its "partner"; for example, splicing has been observed utilizing partners that have as little as 30 to 50% homology with the "natural" splicing partner (see, Dassa, et al., (2007) *Biochemistry.* 46(1):322-30). Other such mixtures of disparate split intein partners have been shown to be unreactive one with another (see, Brenzel, et al., (2006) *Biochemistry.* 45(6):1571-8). However, it is within the ability of a person skilled in the relevant art to determine whether a pair of polypeptides can associate with each other to provide a functional intein, using routine methods and without the exercise of inventive skill.

In some embodiments, the IPD113 polypeptide is a circular permuted variant. In certain embodiments, the IPD113 polypeptide is a circular permuted variant of the polypeptide of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495, or variant thereof having an amino acid substitution, deletion, addition or combinations thereof. The development of recombinant DNA methods has made it possible to study the effects of sequence transposition on protein folding, structure and function. The approach used in creating new sequences resembles that of naturally occurring pairs of proteins that are related by linear reorganization of their amino acid sequences (Cunningham, et al., (1979) *Proc. Natl. Acad. Sci. U.S.A.* 76:3218-3222; Teather and Erfle, (1990) *J. Bacteriol.* 172:3837-3841; Schimming, et al., (1992) *Eur. J. Biochem.* 204:13-19; Yamiuchi and Minamikawa, (1991) *FEBS Lett.* 260:127-130; MacGregor, et al., (1996) *FEBS Lett.* 378:263-266). The first in vitro application of this type of rearrangement to proteins was described by Goldenberg and Creighton (*J. Mol. Biol.* 165:407-413, 1983). In creating a circular permuted variant, a new N-terminus is selected at an internal site (breakpoint) of the original sequence, the new sequence having the same order of amino acids as the original from the breakpoint until it reaches an amino acid that is at or near the original C-terminus. At this point the new sequence is joined, either directly or through an additional portion of sequence (linker), to an amino acid that is at or near the original N-terminus and the new sequence continues with the same sequence as the original until it reaches a point that is at or near the amino acid that was N-terminal to the breakpoint site of the original sequence, this residue forming the new C-terminus of the chain. The length of the amino acid sequence of the linker can be selected empirically or with guidance from structural information or by using a combination of the two approaches. When no structural information is available, a small series of linkers can be prepared for testing using a design whose length is varied to span a range from 0 to 50 Å and whose sequence is chosen to be consistent with surface exposure (hydrophilicity, Hopp and Woods, (1983) *Mol. Immunol.* 20:483-489; Kyte and Doolittle, (1982) *J. Mol. Biol.* 157:105-132; solvent exposed surface area, Lee and Richards, (1971) *J. Mol. Biol.* 55:379-400) and the ability to adopt the necessary conformation without deranging the configuration of the pesticidal polypeptide (conformationally flexible; Karplus and Schulz, (1985) *Naturwissenschaften* 72:212-213). Assuming an average of translation of 2.0 to 3.8 Å per residue, this would mean the length to test would be between 0 to 30 residues, with 0 to 15 residues being the preferred range. Exemplary of such an empirical series would be to construct linkers using a cassette sequence such as Gly-Gly-Gly-Ser repeated n times, where n is 1, 2, 3 or 4. Those skilled in the art will recognize that there are many such sequences that vary in length or composition that can serve as linkers with the primary consideration being that they be neither excessively long nor short (cf., Sandhu, (1992) *Critical Rev. Biotech.* 12:437-462); if they are too long, entropy effects will likely destabilize the three-dimensional fold, and may also make folding kinetically impractical, and if they are too short, they will likely destabilize the molecule because of torsional or steric strain. Those skilled in the analysis of protein structural information will recognize that using the distance between the chain ends, defined as the distance between the c-alpha carbons, can be used to define the length of the sequence to be used or at least to limit the number of possibilities that must be tested in an empirical selection of linkers. They will also recognize that it is sometimes the case that the positions of the ends of the polypeptide chain are ill-defined in structural models derived from x-ray diffraction or nuclear magnetic resonance spectroscopy data, and that when true, this situation will therefore need to be considered to properly estimate the length of the linker required. From those residues, whose positions are well defined are selected two residues that are close in sequence to the chain ends, and the distance between their c-alpha carbons is used to calculate an approximate length for a linker between them. Using the calculated length as a guide, linkers with a range of number of residues (calculated using 2 to 3.8 Å per residue) are then selected. These linkers may be composed of the original sequence, shortened or lengthened as necessary, and when lengthened the additional residues may be chosen to be flexible and hydrophilic as described above; or optionally the original sequence may be substituted for using a series of linkers, one example being the Gly-Gly-Gly-Ser cassette approach mentioned above; or optionally a combination of the original sequence and new sequence having the appropriate total length may be used.

Sequences of pesticidal polypeptides capable of folding to biologically active states can be prepared by appropriate selection of the beginning (amino terminus) and ending (carboxyl terminus) positions from within the original polypeptide chain while using the linker sequence as described above. Amino and carboxyl termini are selected from within a common stretch of sequence, referred to as a breakpoint region, using the guidelines described below. A novel amino acid sequence is thus generated by selecting amino and carboxyl termini from within the same breakpoint region. In many cases the selection of the new termini will be such that the original position of the carboxyl terminus immediately preceded that of the amino terminus. However, those skilled in the art will recognize that selections of termini anywhere within the region may function, and that these will effectively lead to either deletions or additions to the amino or carboxyl portions of the new sequence. It is a central tenet of molecular biology that the primary amino acid sequence of a protein dictates folding to the three-dimensional structure necessary for expression of its biological function. Methods are known to those skilled in the art to obtain and interpret three-dimensional structural information using x-ray diffraction of single protein Crystals or nuclear magnetic resonance spectroscopy of protein solutions. Examples of structural information that are relevant to the identification of breakpoint regions include the location and type of protein secondary structure (alpha and 3-10 helices, parallel and anti-parallel beta sheets, chain reversals and turns, and loops; Kabsch and Sander, (1983) *Biopolymers* 22:2577-2637; the degree of solvent exposure of amino acid residues, the extent and type of interactions of residues with one another (Chothia, (1984) *Ann. Rev. Biochem.* 53:537-572) and the static and dynamic distribution of conformations along the polypeptide chain (Alber and Mathews, (1987) *Methods Enzymol.* 154:511-533). In some cases, additional information is known about solvent exposure of residues; one example is a site of post-translational attachment of carbohydrate which is necessarily on the surface of the protein. When experimental structural information is not available or is not feasible to obtain, methods are also available to analyze the primary amino acid sequence to make predictions of protein tertiary and secondary structure, solvent accessibility and the occurrence of turns and loops. Biochemical methods are also sometimes applicable for empirically determining surface exposure when direct structural methods are not feasible; for example, using the identification of sites of chain scission following limited proteolysis to infer surface exposure (Gentile and Salvatore, (1993) *Eur. J. Biochem.* 218:603-621). Thus, using either the experimentally derived structural information or predictive methods (e.g., Srinivisan and Rose, (1995) *Proteins: Struct., Funct. & Genetics* 22:81-99) the parental amino acid sequence is inspected to classify regions according to whether they are integral to the maintenance of secondary and tertiary structure. The occurrence of sequences within regions that are known to be involved in periodic secondary structure (alpha and 3-10 helices, parallel and anti-parallel beta sheets) are regions that should be avoided. Similarly, regions of amino acid sequence that are observed or predicted to have a low degree of solvent exposure are more likely to be part of the so-called hydrophobic core of the protein and should also be avoided for selection of amino and carboxyl termini. In contrast, those regions that are known or predicted to be in surface turns or loops, and especially those regions that are known not to be required for biological activity, are the preferred sites for location of the extremes of the polypeptide chain. Continuous stretches of amino acid sequence that are preferred based on the above criteria are referred to as a breakpoint region. Polynucleotides encoding circular permuted IPD113 polypeptides with new N-terminus/C-terminus which contain a linker region separating the original C-terminus and N-terminus can be made essentially following the method described in Mullins, et al., (1994) *J. Am. Chem. Soc.* 116:5529-5533. Multiple steps of polymerase chain reaction (PCR) amplifications are used to rearrange the DNA sequence encoding the primary amino acid sequence of the protein. Polynucleotides encoding circular permuted IPD113 polypeptides with new N-terminus/C-terminus which contain a linker region separating the original C-terminus and N-terminus can be made based on the tandem-duplication method described in Horlick, et al., (1992) *Protein Eng.* 5:427-431. Polymerase chain reaction (PCR) amplification of the new N-terminus/C-terminus genes is performed using a tandemly duplicated template DNA.

In another embodiment, fusion proteins are provided that include within its amino acid sequence an amino acid sequence comprising an IPD113 polypeptide or chimeric IPD113 polypeptide of the disclosure. Polynucleotides encoding an IPD113 polypeptide may be fused to signal sequences which will direct the localization of the IPD113 polypeptide to particular compartments of a prokaryotic or eukaryotic cell and/or direct the secretion of the IPD113 polypeptide of the embodiments from a prokaryotic or eukaryotic cell. For example, in *E. coli*, one may wish to direct the expression of the protein to the periplasmic space. Examples of signal sequences or proteins (or fragments thereof) to which the IPD113 polypeptide may be fused to direct the expression of the polypeptide to the periplasmic space of bacteria include, but are not limited to, the pelB signal sequence, the maltose binding protein (MBP) signal sequence, MBP, the ompA signal sequence, the signal sequence of the periplasmic *E. coli* heat-labile enterotoxin B-subunit and the signal sequence of alkaline phosphatase. Several vectors are commercially available for the construction of fusion proteins which will direct the localization of a protein, such as the pMAL series of vectors (particularly the pMAL-p series) available from New England Biolabs. In a specific embodiment, the IPD113 polypeptide may be fused to the pelB pectate lyase signal sequence to increase the efficiency of expression and purification of such polypeptides in Gram-negative bacteria (see, U.S. Pat. Nos. 5,576,195 and 5,846,818). The IPD113 polypeptides of the embodiments may be fused to a plant plastid transit peptide or apoplast transit peptides such as rice or barley alpha-amylase secretion signal. The plastid transit peptide is generally fused N-terminal to the polypeptide to be targeted (e.g., the fusion partner). In one embodiment, the fusion protein consists essentially of the plastid transit peptide and the IPD113 polypeptide to be targeted. In another embodiment, the fusion protein comprises the plastid transit peptide and the polypeptide to be targeted. In such embodiments, the plastid transit peptide is preferably at the N-terminus of the fusion protein. However, additional amino acid residues may be N-terminal to the plastid transit peptide if the fusion protein is at least partially targeted to a plastid. In a specific embodiment, the plastid transit peptide is in the N-terminal half, N-terminal third or N-terminal quarter of the fusion protein. Most or all of the plastid transit peptide is generally cleaved from the fusion protein upon insertion into the plastid. The position of cleavage may vary slightly between plant species, at different plant developmental stages, because of specific intercellular conditions or the combination of transit peptide/fusion partner used. In one embodiment, the plastid transit peptide cleavage is homogenous such that the cleavage site is identical in a population of fusion proteins. In another embodiment, the plastid transit peptide is not homogenous, such that the cleavage site varies by 1-10 amino acids in a population of fusion proteins. The plastid transit peptide can be recombinantly fused to a second protein in one of several ways. For example, a restriction endonuclease recognition site can be introduced into the nucleotide sequence of the transit peptide at a position corresponding to its C-terminal end and the same or a compatible site can be engineered into the nucleotide sequence of the protein to be targeted at its N-terminal end. Care must be taken in designing these sites to ensure that the coding sequences of the transit peptide and the second protein are kept "in frame" to allow the synthesis of the desired fusion protein. In some cases, it may be preferable to remove the initiator methionine of the second protein when the new restriction site is introduced. The introduction of restriction endonuclease recognition sites on both parent molecules and their subsequent joining through recombinant DNA techniques may result in the addition of one or more extra amino acids between the transit peptide and the second protein. This generally does not affect targeting activity if the transit peptide cleavage site remains accessible and the function of the second protein is not altered by the addition of these extra amino acids at its N-terminus. Alternatively, one skilled in the art can create a precise cleavage site between the transit peptide and the second protein (with or without its initiator methionine) using gene synthesis (Stemmer, et al., (1995) *Gene* 164:49-53) or similar methods. In addition, the transit peptide fusion can intentionally include amino acids downstream of the cleavage site. The amino acids at the N-terminus of the mature protein can affect the ability of the transit peptide to target proteins to plastids and/or the efficiency of cleavage following protein import. This may be dependent on the protein to be targeted. See, e.g., Comai, et al., (1988) *J. Biol. Chem.* 263(29):15104-9. In some embodiments, the IPD113 polypeptide is fused to a heterologous signal peptide or heterologous transit peptide.

In some embodiments, fusion proteins are provide comprising an IPD113 polypeptide or chimeric IPD113 polypeptide of the disclosure represented by a formula selected from the group consisting of:

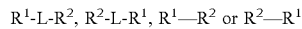

$R^1$-L-$R^2$, $R^2$-L-$R^1$, $R^1$—$R^2$ or $R^2$—$R^1$ wherein $R^1$ is an IPD113 polypeptide or chimeric IPD113 polypeptide of the disclosure and $R^2$ is a protein of interest. In some embodiments, $R^1$ and $R^2$ are an IPD113 polypeptide or chimeric IPD113 polypeptide of the disclosure. The $R^1$ polypeptide is fused either directly or through a linker (L) segment to the $R^2$ polypeptide. The term "directly" defines fusions in which the polypeptides are joined without a peptide linker. Thus "L" represents a chemical bound or polypeptide segment to which both $R^1$ and $R^2$ are fused in frame, most commonly L is a linear peptide to which $R^1$ and $R^2$ are bound by amide bonds linking the carboxy terminus of $R^1$ to the amino terminus of L and carboxy terminus of L to the amino terminus of $R^2$. By "fused in frame" is meant that there is no translation termination or disruption between the reading frames of $R^1$ and $R^2$. The linking group (L) is generally a polypeptide of between 1 and 500 amino acids in length. The linkers joining the two molecules are preferably designed to (1) allow the two molecules to fold and act independently of each other, (2) not have a propensity for developing an ordered secondary structure which could interfere with the functional domains of the two proteins, (3) have minimal hydrophobic or charged characteristic which could interact with the functional protein domains and (4) provide steric separation of $R^1$ and $R^2$ such that $R^1$ and $R^2$ could interact simultaneously with their corresponding receptors on a single cell. Typically surface amino acids in flexible protein regions include Gly, Asn and Ser. Virtually any permutation of amino acid sequences containing Gly, Asn and Ser would be expected to satisfy the above criteria for a linker sequence. Other neutral amino acids, such as Thr and Ala, may also be used in the linker sequence. Additional amino acids may also be included in the linkers due to the addition of unique restriction sites in the linker sequence to facilitate construction of the fusions.

In some embodiments, the linkers comprise sequences selected from the group of formulas: $(Gly_3Ser)_n$, $(Gly_4Ser)_n$, $(Gly_5Ser)_n$, $(Gly_nSer)_n$ or $(AlaGlySer)_n$ where n is an integer. One example of a highly-flexible linker is the (GlySer)-rich spacer region present within the pIII protein of the filamentous bacteriophages, e.g. bacteriophages M13 or fd (Schaller, et al., 1975). This region provides a long, flexible spacer region between two domains of the pIII surface protein. Also included are linkers in which an endopeptidase recognition sequence is included. Such a cleavage site may be valuable to separate the individual components of the fusion to determine if they are properly folded and active in vitro. Examples of various endopeptidases include, but are not limited to, Plasmin, Enterokinase, Kallikerin, Urokinase, Tissue Plasminogen activator, clostripain, Chymosin, Collagenase, Russell's Viper Venom Protease, Postproline cleavage enzyme, V8 protease, Thrombin and factor Xa. In some embodiments, the linker comprises the amino acids EEKKN (SEQ ID NO: 334) from the multi-gene expression vehicle (MGEV), which is cleaved by vacuolar proteases as disclosed in US Patent Application Publication Number US 2007/0277263. In other embodiments, peptide linker segments from the hinge region of heavy chain immunoglobulins IgG, IgA, IgM, IgD or IgE provide an angular relationship between the attached polypeptides. Especially useful are those hinge regions where the cysteines are replaced with serines. Linkers of the present disclosure include sequences derived from murine IgG gamma 2b hinge region in which the cysteines have been changed to serines. The fusion proteins are not limited by the form, size or number of linker sequences employed and the only requirement of the linker is that functionally it does not interfere adversely with the folding and function of the individual molecules of the fusion.

Nucleic Acid Molecules, and Variants and Fragments Thereof

Isolated or recombinant nucleic acid molecules comprising nucleic acid sequences encoding IPD113 polypeptides or biologically active portions thereof, as well as nucleic acid molecules sufficient for use as hybridization probes to identify nucleic acid molecules encoding proteins with regions of sequence homology are provided. As used herein, the term "nucleic acid molecule" refers to DNA molecules (e.g., recombinant DNA, cDNA, genomic DNA, plastid DNA, mitochondrial DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule (or DNA) is used herein to refer to a nucleic acid sequence (or DNA) that is no longer in its natural environment, for example in vitro. A "recombinant" nucleic acid molecule (or DNA) is used herein to refer to a nucleic acid sequence (or DNA) that is in a recombinant bacterial or plant host cell. In some embodiments, an "isolated" or "recombinant" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For purposes of the disclosure, "isolated" or "recombinant" when used to refer to nucleic acid molecules excludes isolated chromosomes. For example, in various embodiments, the recombinant nucleic acid molecules encoding IPD113 polypeptides can contain less than about 5 kb, 4 kb, 3 kb, 2 kb, 1 kb, 0.5 kb or 0.1 kb of nucleic acid sequences that naturally flank the nucleic acid molecule in genomic DNA of the cell from which the nucleic acid is derived.

In some embodiments, an isolated nucleic acid molecule encoding IPD113 polypeptides has one or more change in the nucleic acid sequence compared to the native or genomic nucleic acid sequence. In some embodiments, the change in the native or genomic nucleic acid sequence includes but is not limited to: changes in the nucleic acid sequence due to the degeneracy of the genetic code; changes in the nucleic acid sequence due to the amino acid substitution, insertion, deletion and/or addition compared to the native or genomic sequence; removal of one or more intron; deletion of one or more upstream or downstream regulatory regions; and deletion of the 5' and/or 3' untranslated region associated with the genomic nucleic acid sequence. In some embodiments, the nucleic acid molecule encoding an IPD113 polypeptide is a non-genomic sequence.

A variety of polynucleotides that encode IPD113 polypeptides or related proteins are contemplated. Such polynucleotides are useful for production of IPD113 polypeptides in host cells when operably linked to a suitable promoter, transcription termination and/or polyadenylation sequences. Such polynucleotides are also useful as probes for isolating homologous or substantially homologous polynucleotides that encode IPD113 polypeptides or related proteins.

Methods for Engineering IPD113 Polypeptides

Methods for engineering IPD113 polypeptides are also encompassed by the disclosure. In some embodiments, the method for engineering IPD113 polypeptides uses rational protein design based on a secondary, tertiary or quaternary structure model of the IPD113 polypeptide. In-silico modeling tools can be used in the methods of the disclosure. In some embodiments, the rational protein design uses an in-silico modeling tool selected from, but not limited to, PyMOL (PyMOL Molecular Graphics System, Version 1.7.4 Schrödinger, LLC.), Maestro©, BioLuminate (Zhu, K.; et al., Proteins, 2014, 82(8), 1646-1655; Salam, N. K et al., Protein Eng. Des. Sel., 2014, 27(10), 365-74; Beard, H. et al. PLoS ONE, 2013, 8(12), e82849), MOE© (Molecular Operating Environment (MOE), 2013.08; Chemical Computing Group Inc., 1010 Sherbooke St. West, Suite #910, Montreal, QC, Canada, H3A 2R7, 2015), Jmol, and Discovery Studio© (Accelrys Software Inc. Discovery Studio Modeling Environment, Release 3.5.0, San Diego: Accelrys Software Inc. 2013). In some embodiments, the modeling uses Discovery Studio© software. In some embodiments, the method the structural coordinates can be determined by homology modeling. In some embodiments, the method the structural coordinates can be determined by X-ray crystallography or solution NMR.

In some embodiments, the IPD113 polypeptide is engineered by the method of the disclosure to have a modified physical property compared to the native IPD113 polypeptide. In some embodiments, the modified physical properties include, but are not limited to net surface charge and charge distribution on the protein surface, net hydrophobicity and hydrophobic residue distribution on the protein surface, surface charge density, surface hydrophobicity density, total count of surface ionizable groups, and protein size. In some embodiments, the modified physical in-properties include, but are not limited to solubility, folding, stability, protease stability, digestibility, planta expression, insecticidal potency, spectrum of insecticidal activity, ion channel activity of protomer pore, and receptor binding. In some embodiments, the modified physical property is improved protease stability, improved in-planta expression, improved solubility, improved potency, improved ion-channel activity of protomer pore, and/or improved receptor binding.

Using the methods of the disclosure, proteolytically-sensitive sites can be identified and may be modified or utilized to produce more stable or more biologically active IPD113 polypeptides.

Using methods of the disclosure, sites involved in receptor binding and/or pore formation can be identified and may be modified to create IPD113 polypeptides having enhanced insecticidal activity; enhanced ability to form channels; and reduced size.

Using methods of the disclosure, occupation of a site by a water molecule can be identified and can be modified to create IPD113 molecules having modified flexibility in a region or increasing the number of hydrophobic residues along that surface, which may be involved in receptor binding and/or pore formation.

Using methods of the disclosure, hydrogen bonding in a region can be identified and the amino acids may be substituted to modify the number of hydrogen bonds, including salt bridges, to create IPD113 polypeptides having a modified hydrophobic interaction surface facilitating pre-pore and pore formation and/or modified insecticidal activity.

Using methods of the disclosure, loop regions can be identified and may be modified to create IPD113 polypeptides having modified channel or pore formation, folding, and/or receptor binding.

Using methods of the disclosure, complex electrostatic surfaces and hydrophobic or hydrophilic interactions can be identified and modified to create IPD113 polypeptides having modified receptor interaction Using methods of the disclosure, metal binding sites can be identified and modified to create IPD113 polypeptides having modified ion channel or pore activity.

Using methods of the disclosure, amino acids that may be buried or otherwise removed from the surface of the protein that hold in place the three-dimensional structure can be identified and modified to create IPD113 polypeptides having modified stability or flexibility.

Using methods of the disclosure, non-specific binding sites to other biomolecules can be identified and modified to create IPD113 polypeptides having modified receptor binding to the specific receptor and enhanced toxicity.

Appling various computational tools coupled with the understanding of saturated mutagenesis, and the structural/functional relationship for IPD113 polypeptides as disclosed herein, one skilled in the art can identify and modify various physical properties of IPD113 polypeptides for the better overall performance as an insecticidal protein against the desired targets. Combinatory mutagenesis at various regions can enhance specificity to the current active targets and potentially can also change activity spectrum against different targets. Such targeted combinatorial mutagenesis can be achieved with incorporation of mutagenic oligo nucleotides or generated by gene synthesis or the combination of both approaches. Mutagenesis on defined loop regions can also enhance physical properties of IPD113 polypeptides such as increasing protein stability by reducing protease degradation ability and increasing thermostability etc. In additional, combinatorial mutagenesis can be applied to the amino acid residues involved in hydrophobic interface surface. Enhancement of hydrophobic interface surface can potentially increase insecticidal activity, thermostability and other physical properties. Additional improvements can also be achieved through mutagenesis of other part of the molecule such as various beta-sheets and alpha helices to increase stability and activity.

Polynucleotides Encoding IPD113 Polypeptides

One source of polynucleotides that encode IPD113 polypeptides or related proteins is a fern or other primitive plant species selected from, but not limited to, limited to *Pteris, Polypodium, Nephrolepis, Colysis, Tectaria, Davallia, Polystichum, Adiantum, Asplenium, Blechnum, Lygodium, Ophioglossum, Pyrrosia, Doryopteris, Dryopteris, Pellaea, Gymnocarpium, Cheilanthes, Pteridium, Christella, Lastreopsis, Campyloneurum, Hemionitis, Selliguea*, and *Arachniodes* species, which contains an IPD113 polynucleotide of SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309. SEQ ID NO: 310, SEQ ID NO: 321, SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 335, SEQ ID NO: 338, SEQ ID NO: 339, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 349, SEQ ID NO: 350, SEQ ID NO: 351, SEQ ID NO: 352, SEQ ID NO: 353, SEQ ID NO: 354, SEQ ID NO: 355, SEQ ID NO: 357, SEQ ID NO: 358, SEQ ID NO: 359, SEQ ID NO: 360, SEQ ID NO: 362, SEQ ID NO: 364, SEQ ID NO: 366, SEQ ID NO: 367, SEQ ID NO: 369, SEQ ID NO: 370, SEQ ID NO: 371, SEQ ID NO: 372, SEQ ID NO: 377, SEQ ID NO: 379, SEQ ID NO: 380, SEQ ID NO: 382, SEQ ID NO: 385, SEQ ID NO: 388, SEQ ID NO: 389, SEQ ID NO: 391, SEQ ID NO: 392, SEQ ID NO: 393, SEQ ID NO: 394, SEQ ID NO: 396, SEQ ID NO: 397, SEQ ID NO: 398, SEQ ID NO: 399, SEQ ID NO: 400, SEQ ID NO: 401, SEQ ID NO: 402, SEQ ID NO: 403, SEQ ID NO: 404, SEQ ID NO: 405, SEQ ID NO: 406, SEQ ID NO: 407, SEQ ID NO: 408, SEQ ID NO: 409, SEQ ID NO: 410, SEQ ID NO: 411, SEQ ID NO: 413, and SEQ ID NO: 414 encoding an IPD113 polypeptide of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO:

275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494, and SEQ ID NO: 495 respectively.

The polynucleotides of SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309. SEQ ID NO: 310, SEQ ID NO: 321, SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 335, SEQ ID NO: 338, SEQ ID NO: 339, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 349, SEQ ID NO: 350, SEQ ID NO: 351, SEQ ID NO: 352, SEQ ID NO: 353, SEQ ID NO: 354, SEQ ID NO: 355, SEQ ID NO: 357, SEQ ID NO: 358, SEQ ID NO: 359, SEQ ID NO: 360, SEQ ID NO: 362, SEQ ID NO: 364, SEQ ID NO: 366, SEQ ID NO: 367, SEQ ID NO: 369, SEQ ID NO: 370, SEQ ID NO: 371, SEQ ID NO: 372, SEQ ID NO: 377, SEQ ID NO: 379, SEQ ID NO: 380, SEQ ID NO: 382, SEQ ID NO: 385, SEQ ID NO: 388, SEQ ID NO: 389, SEQ ID NO: 391, SEQ ID NO: 392, SEQ ID NO: 393, SEQ ID NO: 394, SEQ ID NO: 396, SEQ ID NO: 397, SEQ ID NO: 398, SEQ ID NO: 399, SEQ ID NO: 400, SEQ ID NO: 401, SEQ ID NO: 402, SEQ ID NO: 403, SEQ ID NO: 404, SEQ ID NO: 405, SEQ ID NO: 406, SEQ ID NO: 407, SEQ ID NO: 408, SEQ ID NO: 409, SEQ ID NO: 410, SEQ ID NO: 411, SEQ ID NO: 413, and SEQ ID NO: 414 can be used to express IPD113 polypeptides in recombinant bacterial hosts that include but are not limited to *Agrobacterium, Bacillus, Escherichia, Salmonella, Pseudomonas* and *Rhizobium* bacterial host cells. The polynucleotides are also useful as probes for isolating homologous or substantially homologous polynucleotides that encode IPD113 polypeptides or related proteins. Such probes can be used to identify homologous or substantially homologous polynucleotides derived from fern or other primitive plant species selected from, but not limited to, *Pteris, Polypodium, Nephrolepis, Colysis, Tectaria, Davallia, Polystichum, Adiantum, Asplenium, Blechnum, Lygodium, Ophioglossum, Pyrrosia, Doryopteris, Dryopteris, Pellaea, Gymnocarpium, Cheilanthes, Pteridium, Christella, Lastreopsis, Campyloneurum, Hemionitis, Selliguea*, and *Arachniodes* species.

Polynucleotides that encode IPD113 polypeptides can also be synthesized de novo from an IPD113 polypeptide sequence. The sequence of the polynucleotide gene can be deduced from an IPD113 polypeptide sequence through use of the genetic code. Computer programs such as "Back-Translate" (GCG™ Package, Acclerys, Inc. San Diego, Calif.) can be used to convert a peptide sequence to the corresponding nucleotide sequence encoding the peptide. Examples of IPD113 polypeptide sequences that can be used to obtain corresponding nucleotide encoding sequences include, but are not limited to the IPD113 polypeptides of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495. Furthermore, synthetic IPD113 polynucleotide sequences of the disclosure can be designed so that they will be expressed in plants.

In some embodiments, the nucleic acid molecule encoding an IPD113 polypeptide is a polynucleotide having the sequence set forth in SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309. SEQ ID NO: 310, SEQ ID NO: 321, SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 335, SEQ ID NO: 338, SEQ ID NO: 339, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 349, SEQ ID NO: 350, SEQ ID NO: 351, SEQ ID NO: 352, SEQ ID NO: 353, SEQ ID NO: 354, SEQ ID NO: 355, SEQ ID NO: 357, SEQ ID NO: 358, SEQ ID NO: 359, SEQ ID NO: 360, SEQ ID NO: 362, SEQ ID NO: 364, SEQ ID NO: 366, SEQ ID NO: 367, SEQ ID NO: 369, SEQ ID NO: 370, SEQ ID NO: 371, SEQ ID NO: 372, SEQ ID NO: 377, SEQ ID NO: 379, SEQ ID NO: 380, SEQ ID NO: 382, SEQ ID NO: 385, SEQ ID NO: 388, SEQ ID NO: 389, SEQ ID NO: 391, SEQ ID NO: 392, SEQ ID NO: 393, SEQ ID NO: 394, SEQ ID NO: 396, SEQ ID NO: 397, SEQ ID NO: 398, SEQ ID NO: 399, SEQ ID NO: 400, SEQ ID NO: 401, SEQ ID NO: 402, SEQ ID NO: 403, SEQ ID NO: 404, SEQ ID NO: 405, SEQ ID NO: 406, SEQ ID NO: 407, SEQ ID NO: 408, SEQ ID NO: 409, SEQ ID NO: 410, SEQ ID NO: 411, SEQ ID NO: 413 or SEQ ID NO: 414 and variants, fragments and complements thereof. Nucleic acid sequences that are complementary to a nucleic acid sequence of the embodiments or that hybridize to a sequence of the embodiments are also encompassed. The nucleic acid sequences can be used in DNA constructs or expression cassettes for transformation and expression in organisms, including microorganisms and plants. The nucleotide or amino acid sequences may be synthetic sequences that have been designed for expression in an organism including, but not limited to, a microorganism or a plant.

"Complement" is used herein to refer to a nucleic acid sequence that is sufficiently complementary to a given nucleic acid sequence such that it can hybridize to the given nucleic acid sequence to thereby form a stable duplex. "Polynucleotide sequence variants" is used herein to refer to a nucleic acid sequence that except for the degeneracy of the genetic code encodes the same polypeptide.

In some embodiments, the nucleic acid molecule encoding the IPD113 polypeptide is a non-genomic nucleic acid sequence. As used herein a "non-genomic nucleic acid sequence" or "non-genomic nucleic acid molecule" or "non-genomic polynucleotide" refers to a nucleic acid molecule that has one or more change in the nucleic acid sequence compared to a native or genomic nucleic acid sequence. In some embodiments, the change to a native or genomic nucleic acid molecule includes but is not limited to: changes in the nucleic acid sequence due to the degeneracy of the genetic code; optimization of the nucleic acid sequence for expression in plants; changes in the nucleic acid sequence to introduce at least one amino acid substitution, insertion, deletion and/or addition compared to the native or genomic sequence; removal of one or more intron associated with the genomic nucleic acid sequence; insertion of one or more heterologous introns; deletion of one or more upstream or downstream regulatory regions associated with the genomic nucleic acid sequence; insertion of one or more heterologous upstream or downstream regulatory regions; deletion of the 5' and/or 3' untranslated region associated with the genomic nucleic acid sequence; insertion of a heterologous 5' and/or 3' untranslated region; and modification of a polyadenylation site. In some embodiments, the non-genomic nucleic acid molecule is a synthetic nucleic acid sequence.

In some embodiments, the nucleic acid molecule encoding an IPD113 polypeptide is a non-genomic polynucleotide having a nucleotide sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity, to the nucleic acid sequence of SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309. SEQ ID NO: 310, SEQ ID NO: 321, SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 335, SEQ ID NO: 338, SEQ ID NO: 339, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 349, SEQ ID NO: 350, SEQ ID NO: 351, SEQ ID NO: 352, SEQ ID NO: 353, SEQ ID NO: 354, SEQ ID NO: 355, SEQ ID NO: 357, SEQ ID NO: 358, SEQ ID NO: 359, SEQ ID NO: 360, SEQ ID NO: 362, SEQ ID NO: 364, SEQ ID NO: 366, SEQ ID NO: 367, SEQ ID NO: 369, SEQ ID NO: 370, SEQ ID NO: 371, SEQ ID NO: 372, SEQ ID NO: 377, SEQ ID NO: 379, SEQ ID NO: 380, SEQ ID NO: 382, SEQ ID NO: 385, SEQ ID NO: 388, SEQ ID NO: 389, SEQ ID NO: 391, SEQ ID NO: 392, SEQ ID NO: 393, SEQ ID NO: 394, SEQ ID NO: 396, SEQ ID NO: 397, SEQ ID NO: 398, SEQ ID NO: 399, SEQ ID NO: 400, SEQ ID NO: 401, SEQ ID NO: 402, SEQ ID NO: 403, SEQ ID NO: 404, SEQ ID NO: 405, SEQ ID NO: 406, SEQ ID NO: 407, SEQ ID NO: 408, SEQ ID NO: 409, SEQ ID NO: 410, SEQ ID NO: 411, SEQ ID NO: 413 or SEQ ID NO: 414, wherein the encoded IPD113 polypeptide has insecticidal activity.

In some embodiments, the IPD113 polynucleotide encodes an IPD113 polypeptide having at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494, or SEQ ID NO: 495 and has at least one amino acid substitution, deletion, insertion or combination therefore, compared to the native sequence.

In some embodiments, the nucleic acid molecule encodes an IPD113 polypeptide comprises an amino acid sequence having at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 27, SEQ ID NO: 30, SEQ ID NO: 35, SEQ ID NO: 36, SEQ ID NO: 37, SEQ ID NO: 38, SEQ ID NO: 77, SEQ ID NO: 88, SEQ ID NO: 89, SEQ ID NO: 90, SEQ ID NO: 91, SEQ ID NO: 93, SEQ ID NO: 94, SEQ ID NO: 95, SEQ ID NO: 96, SEQ ID NO: 97, SEQ ID NO: 98, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 110, SEQ ID NO: 111, SEQ ID NO: 112, SEQ ID NO: 113 or SEQ ID NO: 114.

In some embodiments, the nucleic acid molecule encodes an IPD113 polypeptide comprises an amino acid sequence having at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 24, SEQ ID NO: 93, SEQ ID NO: 94, SEQ ID NO: 95, SEQ ID NO: 96, SEQ ID NO: 103, SEQ ID NO: 104, SEQ ID NO: 105, SEQ ID NO: 106, SEQ ID NO: 107, SEQ ID NO: 39 or SEQ ID NO: 40.

In some embodiments, the nucleic acid molecule encodes an IPD113 polypeptide comprises an amino acid sequence having at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 88, SEQ ID NO: 89, SEQ ID NO: 90 or SEQ ID NO: 91.

In some embodiments, the nucleic acid molecule encodes an IPD113 polypeptide comprises an amino acid sequence having at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 20, SEQ ID NO: 24 or SEQ ID NO: 27.

In some embodiments, the nucleic acid molecule encodes an IPD113 polypeptide comprises an amino acid sequence having at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 13, SEQ ID NO: 14, SEQ ID NO: 15, SEQ ID NO: 21 or SEQ ID NO: 22.

In some embodiments, the nucleic acid molecule encodes an IPD113 polypeptide comprises an amino acid sequence having at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 17, SEQ ID NO: 18, SEQ ID NO: 19, SEQ ID NO: 38, SEQ ID NO: 77, SEQ ID NO: 110, SEQ ID NO: 111 or SEQ ID NO: 112.

In some embodiments, the nucleic acid molecule encodes an IPD113 polypeptide comprises an amino acid sequence having at least about 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 9, SEQ ID NO: 10, SEQ ID NO: 11, SEQ ID NO: 12, SEQ ID NO: 16, SEQ ID NO: 23, SEQ ID NO: 35, SEQ ID NO: 36, SEQ ID NO: 37, SEQ ID NO: 97, SEQ ID NO: 98, SEQ ID NO: 100, SEQ ID NO: 101, SEQ ID NO: 102, SEQ ID NO: 113 or SEQ ID NO: 114.

In some embodiments, the nucleic acid molecule encodes an IPD113 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 10.

In some embodiments, the nucleic acid molecule encodes an IPD113 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 16.

In some embodiments, the nucleic acid molecule encodes an IPD113 polypeptide comprising an amino acid sequence of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495, having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35 or more amino acid substitutions, deletions and/or insertions compared to the native amino acid at the corresponding position of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495.

Also provided are nucleic acid molecules that encode transcription and/or translation products that are subsequently spliced to ultimately produce functional IPD113 polypeptides. Splicing can be accomplished in vitro or in vivo, and can involve cis- or trans-splicing. The substrate for splicing can be polynucleotides (e.g., RNA transcripts) or polypeptides. An example of cis-splicing of a polynucleotide is where an intron inserted into a coding sequence is removed and the two flanking exon regions are spliced to generate an IPD113 polypeptide encoding sequence. An example of trans-splicing would be where a polynucleotide is encrypted by separating the coding sequence into two or more fragments that can be separately transcribed and then spliced to form the full-length pesticidal encoding sequence. The use of a splicing enhancer sequence, which can be introduced into a construct, can facilitate splicing either in cis or trans-splicing of polypeptides (U.S. Pat. Nos. 6,365,377 and 6,531,316). Thus, in some embodiments, the polynucleotides do not directly encode a full-length IPD113 polypeptide, but rather encode a fragment or fragments of an IPD113 polypeptide. These polynucleotides can be used to express a functional IPD113 polypeptide through a mechanism involving splicing, where splicing can occur at the level of polynucleotide (e.g., intron/exon) and/or polypeptide (e.g., intein/extein). This can be useful, for example, in controlling expression of pesticidal activity, since a functional pesticidal polypeptide will only be expressed if all required fragments are expressed in an environment that permits splicing processes to generate functional product. In another example, introduction of one or more insertion sequences into a polynucleotide can facilitate recombination with a low homology polynucleotide; use of an intron or intein for the insertion sequence facilitates the removal of the intervening sequence, thereby restoring function of the encoded variant.

Nucleic acid molecules that are fragments of these nucleic acid sequences encoding IPD113 polypeptides are also encompassed by the embodiments. "Fragment" as used herein refers to a portion of the nucleic acid sequence encoding an IPD113 polypeptide. A fragment of a nucleic acid sequence may encode a biologically active portion of an IPD113 polypeptide or it may be a fragment that can be used as a hybridization probe or PCR primer using methods disclosed below. Nucleic acid molecules that are fragments of a nucleic acid sequence encoding an IPD113 polypeptide comprise at least about 150, 180, 210, 240, 270, 300, 330 or 360, contiguous nucleotides or up to the number of nucleotides present in a full-length nucleic acid sequence encoding an IPD113 polypeptide disclosed herein, depending upon the intended use. "Contiguous nucleotides" is used herein to refer to nucleotide residues that are immediately adjacent to one another. Fragments of the nucleic acid sequences of the embodiments will encode protein fragments that retain the biological activity of the IPD113 polypeptide and, hence, retain insecticidal activity. "Retains insecticidal activity" is used herein to refer to a polypeptide having at least about 10%, at least about 30%, at least about 50%, at least about 70%, 80%, 90%, 95% or higher of the insecticidal activity of the full-length IPD113 polypeptide. In some embodiments, the insecticidal activity is against a Lepidopteran species. In some embodiments, the insecticidal activity is against one or more insect pests selected from Soy Bean Looper (SBL) (*Pseudoplusia includes*), Fall Armyworm (FAVV) (*Spodoptera frugiperda*), Corn Earworm (CEVV) (*Helicoverpa zea*), Velvet Bean Caterpillar (VBC) (*Anticarsia gemmatalis*) and European Corn Borer (ECB) (*Ostrinia nubialis*).

In some embodiments, the IPD113 polypeptide is encoded by a nucleic acid sequence sufficiently homologous to the nucleic acid sequence of SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309. SEQ ID NO: 310, SEQ ID NO: 321, SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 335, SEQ ID NO: 338, SEQ ID NO: 339, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 349, SEQ ID NO: 350, SEQ ID NO: 351, SEQ ID NO: 352, SEQ ID NO: 353, SEQ ID NO: 354, SEQ ID NO: 355, SEQ ID NO: 357, SEQ ID NO: 358, SEQ ID NO: 359, SEQ ID NO: 360, SEQ ID NO: 362, SEQ ID NO: 364, SEQ ID NO: 366, SEQ ID NO: 367, SEQ ID NO: 369, SEQ ID NO: 370, SEQ ID NO: 371, SEQ ID NO: 372, SEQ ID NO: 377, SEQ ID NO: 379, SEQ ID NO: 380, SEQ ID NO: 382, SEQ ID NO: 385, SEQ ID NO: 388, SEQ ID NO: 389, SEQ ID NO: 391, SEQ ID NO: 392, SEQ ID NO: 393, SEQ ID NO: 394, SEQ ID NO: 396, SEQ ID NO: 397, SEQ ID NO: 398, SEQ ID NO: 399, SEQ ID NO: 400, SEQ ID NO: 401, SEQ ID NO: 402, SEQ ID NO: 403, SEQ ID NO: 404, SEQ ID NO: 405, SEQ ID NO: 406, SEQ ID NO: 407, SEQ ID NO: 408, SEQ ID NO: 409, SEQ ID NO: 410, SEQ ID NO: 411, SEQ ID NO: 413 or SEQ ID NO: 414. "Sufficiently homologous" is used herein to refer to an amino acid or nucleic acid sequence that has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence homology compared to a reference sequence using one of the alignment programs described herein using standard parameters. One of skill in the art will recognize that these values can be appropriately adjusted to determine corresponding homology of proteins encoded by two nucleic acid sequences by considering degeneracy, amino acid similarity, reading frame positioning, and the like. In some embodiments, the sequence homology is against the full-length sequence of the polynucleotide encoding an IPD113 polypeptide or against the full-length sequence of an IPD113 polypeptide.

In some embodiments, the nucleic acid encodes an IPD113 polypeptide having at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495. In some embodiments, the sequence identity is calculated using ClustalW algorithm in the ALIGNX® module of the Vector NTI® Program Suite (Invitrogen Corporation, Carlsbad, Calif.) with all default parameters. In some embodiments, the sequence identity is across the entire length of polypeptide calculated using ClustalW algorithm in the ALIGNX module of the Vector NTI Program Suite (Invitrogen Corporation, Carlsbad, Calif.) with all default parameters.

To determine the percent identity of two or more amino acid sequences or of two or more nucleic acid sequences, the sequences are aligned for optimal comparison purposes. The percent identity between the two sequences is a function of the number of identical positions shared by the sequences (i.e., percent identity=number of identical positions/total number of positions (e.g., overlapping positions)×100). In one embodiment, the two sequences are the same length. In another embodiment, the comparison is across the entirety of the reference sequence (e.g., across the entirety of SEQ ID NO: 16). The percent identity between two sequences can be determined using techniques similar to those described below, with or without allowing gaps. In calculating percent identity, typically exact matches are counted.

Another non-limiting example of a mathematical algorithm utilized for the comparison of sequences is the algorithm of Needleman and Wunsch, (1970) *J. Mol. Biol.* 48(3):443-453, used GAP Version 10 software to determine sequence identity or similarity using the following default parameters: % identity and % similarity for a nucleic acid sequence using GAP Weight of 50 and Length Weight of 3, and the nwsgapdna.cmpii scoring matrix; % identity or % similarity for an amino acid sequence using GAP weight of 8 and length weight of 2, and the BLOSUM62 scoring program. Equivalent programs may also be used. "Equivalent program" is used herein to refer to any sequence comparison program that, for any two sequences in question, generates an alignment having identical nucleotide residue matches and an identical percent sequence identity when compared to the corresponding alignment generated by GAP Version 10.

In some embodiments, the IPD113 polynucleotide encodes an IPD113 polypeptide comprising an amino acid sequence having at least about 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 16.

In some embodiments, polynucleotides are provided encoding chimeric polypeptides comprising regions of at least two different IPD113 polypeptides of the disclosure.

In some embodiments, polynucleotides are provided encoding chimeric polypeptides comprising regions of at least two different IPD113 polypeptides selected from SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495.

In some embodiments, polynucleotides are provided encoding chimeric polypeptides comprising an N-terminal Region of a first IPD113 polypeptide of the disclosure operably fused to a C-terminal Region of a second IPD113 polypeptide of the disclosure.

In some embodiments, polynucleotides are provided encoding chimeric polypeptides comprising an N-terminal Region of a first IPD113 polypeptide operably fused to a C-terminal Region of a second IPD113 polypeptide, where the IPD113 polypeptide is selected from SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO:

281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495.

In some embodiments, an IPD113 polynucleotide encodes the IPD113 polypeptide comprising an amino acid sequence of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495.

The embodiments also encompass nucleic acid molecules encoding IPD113 polypeptide variants. "Variants" of the IPD113 polypeptide encoding nucleic acid sequences include those sequences that encode the IPD113 polypeptides disclosed herein but that differ conservatively because of the degeneracy of the genetic code as well as those that are sufficiently identical as discussed above. Naturally occurring allelic variants can be identified with the use of molecular biology techniques, such as polymerase chain reaction (PCR) and hybridization techniques as outlined below. Variant nucleic acid sequences also include synthetically derived nucleic acid sequences that have been generated, for example, by using site-directed mutagenesis but which still encode the IPD113 polypeptides disclosed as discussed below.

The present disclosure provides isolated or recombinant polynucleotides that encode any of the IPD113 polypeptides disclosed herein. Those having ordinary skill in the art will readily appreciate that due to the degeneracy of the genetic code, a multitude of nucleotide sequences encoding IPD113 polypeptides of the present disclosure exist.

The skilled artisan will further appreciate that changes can be introduced by mutation of the nucleic acid sequences thereby leading to changes in the amino acid sequence of the encoded IPD113 polypeptides, without altering the biological activity of the proteins. Thus, variant nucleic acid molecules can be created by introducing one or more nucleotide substitutions, additions and/or deletions into the corresponding nucleic acid sequence disclosed herein, such that one or more amino acid substitutions, additions or deletions are introduced into the encoded protein. Mutations can be introduced by standard techniques, such as site-directed mutagenesis and PCR-mediated mutagenesis. Such variant nucleic acid sequences are also encompassed by the present disclosure.

Alternatively, variant nucleic acid sequences can be made by introducing mutations randomly along all or part of the coding sequence, such as by saturation mutagenesis, and the resultant mutants can be screened for ability to confer pesticidal activity to identify mutants that retain activity. Following mutagenesis, the encoded protein can be expressed recombinantly, and the activity of the protein can be determined using standard assay techniques.

The polynucleotides of the disclosure and fragments thereof are optionally used as substrates for a variety of recombination and recursive recombination reactions, in addition to standard cloning methods as set forth in, e.g., Ausubel, Berger and Sambrook, i.e., to produce additional pesticidal polypeptide homologues and fragments thereof with desired properties. Methods for producing a variant of any nucleic acid listed herein comprising recursively recombining such polynucleotide with a second (or more) polynucleotide, thus forming a library of variant polynucleotides are also embodiments of the disclosure, as are the libraries produced, the cells comprising the libraries and any recombinant polynucleotide produced by such methods. Additionally, such methods optionally comprise selecting a variant polynucleotide from such libraries based on pesticidal activity, as is wherein such recursive recombination is done in vitro or in vivo.

A variety of diversity generating protocols, including nucleic acid recursive recombination protocols can be used separately, and/or in combination to produce one or more variants of a nucleic acid or set of nucleic acids, as well as variants of encoded proteins. Individually and collectively, these procedures provide robust, widely applicable ways of generating diversified nucleic acids and sets of nucleic acids (including, e.g., nucleic acid libraries) useful, e.g., for the engineering or rapid evolution of nucleic acids, proteins, pathways, cells and/or organisms with new and/or improved characteristics.

While distinctions and classifications are made during the ensuing discussion for clarity, it will be appreciated that the techniques are often not mutually exclusive. Indeed, the various methods can be used singly or in combination, in parallel or in series, to access diverse sequence variants.

The result of any of the diversity generating procedures described herein can be the generation of one or more nucleic acids, which can be selected or screened for nucleic acids with or which confer desirable properties or that encode proteins with or which confer desirable properties. Following diversification by one or more of the methods herein or otherwise available to one of skill, any nucleic acids that are produced can be selected for a desired activity or property, e.g. pesticidal activity or, such activity at a desired pH, etc. This can include identifying any activity that can be detected, for example, in an automated or automatable format, by any of the assays in the art, see, e.g., discussion of screening of insecticidal activity, infra. A variety of related (or even unrelated) properties can be evaluated, in serial or in parallel, at the discretion of the practitioner.

Descriptions of a variety of diversity generating procedures for generating modified nucleic acid sequences, e.g., those coding for polypeptides having pesticidal activity or fragments thereof, are found in the following publications and the references cited therein: Soong, et al., (2000) *Nat Genet* 25(4):436-439; Stemmer, et al., (1999) *Tumor Targeting* 4:1-4; Ness, et al., (1999) *Nat Biotechnol* 17:893-896; Chang, et al., (1999) *Nat Biotechnol* 17:793-797; Minshull and Stemmer, (1999) *Curr Opin Chem Biol* 3:284-290; Christians, et al., (1999) *Nat Biotechnol* 17:259-264; Crameri, et al., (1998) *Nature* 391:288-291; Crameri, et al., (1997) *Nat Biotechnol* 15:436-438; Zhang, et al., (1997) *PNAS USA* 94:4504-4509; Patten, et al., (1997) *Curr Opin Biotechnol* 8:724-733; Crameri, et al., (1996) *Nat Med* 2:100-103; Crameri, et al., (1996) *Nat Biotechnol* 14:315-319; Gates, et al., (1996) *J Mol Biol* 255:373-386; Stemmer, (1996) "Sexual PCR and Assembly PCR" In: *The Encyclopedia of Molecular Biology*. VCH Publishers, New York. pp. 447-457; Crameri and Stemmer, (1995) *BioTechniques* 18:194-195; Stemmer, et al., (1995) *Gene,* 164:49-53; Stemmer, (1995) *Science* 270: 1510; Stemmer, (1995) *Bio/Technology* 13:549-553; Stemmer, (1994) *Nature* 370:389-391 and Stemmer, (1994) *PNAS USA* 91:10747-10751.

Mutational methods of generating diversity include, for example, site-directed mutagenesis (Ling, et al., (1997) *Anal Biochem* 254(2):157-178; Dale, et al., (1996) Methods Mol Biol 57:369-374; Smith, (1985) *Ann Rev Genet* 19:423-462; Botstein and Shortle, (1985) *Science* 229:1193-1201; Carter, (1986) *Biochem J* 237:1-7 and Kunkel, (1987) "The efficiency of oligonucleotide directed mutagenesis" in *Nucleic Acids & Molecular Biology* (Eckstein and Lilley, eds., Springer Verlag, Berlin)); mutagenesis using uracil containing templates (Kunkel, (1985) *PNAS USA* 82:488-492; Kunkel, et al., (1987) *Methods Enzymol* 154:367-382 and Bass, et al., (1988) *Science* 242:240-245); oligonucleotide-directed mutagenesis (Zoller and Smith, (1983) *Methods Enzymol* 100:468-500; Zoller and Smith, (1987) *Methods Enzymol* 154:329-350 (1987); Zoller and Smith, (1982) *Nucleic Acids Res* 10:6487-6500), phosphorothioate-modified DNA mutagenesis (Taylor, et al., (1985) *Nucl Acids Res* 13:8749-8764; Taylor, et al., (1985) *Nucl Acids Res* 13:8765-8787 (1985); Nakamaye and Eckstein, (1986) *Nucl Acids Res* 14:9679-9698; Sayers, et al., (1988) *Nucl Acids Res* 16:791-802 and Sayers, et al., (1988) *Nucl Acids Res* 16:803-814); mutagenesis using gapped duplex DNA (Kramer, et al., (1984) *Nucl Acids Res* 12:9441-9456; Kramer and Fritz, (1987) *Methods Enzymol* 154:350-367; Kramer, et al., (1988) *Nucl Acids Res* 16:7207 and Fritz, et al., (1988) *Nucl Acids Res* 16:6987-6999).

Additional suitable methods include point mismatch repair (Kramer, et al., (1984) *Cell* 38:879-887), mutagenesis using repair-deficient host strains (Carter, et al., (1985) *Nucl Acids* Res 13:4431-4443 and Carter, (1987) *Methods in Enzymol* 154:382-403), deletion mutagenesis (Eghtedarzadeh and Henikoff, (1986) *Nucl Acids Res* 14:5115), restriction-selection and restriction-purification (Wells, et al., (1986) *Phil Trans R Soc Lond A* 317:415-423), mutagenesis by total gene synthesis (Nambiar, et al., (1984) *Science* 223:1299-1301; Sakamar and Khorana, (1988) *Nucl Acids Res* 14:6361-6372; Wells, et al., (1985) *Gene* 34:315-323 and Grundström, et al., (1985) *Nucl Acids Res* 13:3305-3316), double-strand break repair (Mandecki, (1986) *PNAS USA,* 83:7177-7181 and Arnold, (1993) *Curr Opin Biotech* 4:450-455). Additional details on many of the above methods can be found in *Methods Enzymol* Volume 154, which also describes useful controls for trouble-shooting problems with various mutagenesis methods.

Additional details regarding various diversity generating methods can be found in the following US Patents, PCT Publications and Applications and EPO publications: U.S. Pat. Nos. 5,723,323, 5,763,192, 5,814,476, 5,817,483, 5,824,514, 5,976,862, 5,605,793, 5,811,238, 5,830,721, 5,834,252, 5,837,458, WO 1995/22625, WO 1996/33207, WO 1997/20078, WO 1997/35966, WO 1999/41402, WO 1999/41383, WO 1999/41369, WO 1999/41368, EP 752008, EP 0932670, WO 1999/23107, WO 1999/21979, WO 1998/31837, WO 1998/27230, WO 1998/27230, WO 2000/00632, WO 2000/09679, WO 1998/42832, WO 1999/29902, WO 1998/41653, WO 1998/41622, WO 1998/42727, WO 2000/18906, WO 2000/04190, WO 2000/42561, WO 2000/42559, WO 2000/42560, WO 2001/23401 and PCT/US01/06775.

The nucleotide sequences of the embodiments can also be used to isolate corresponding sequences from a fern, including but not limited to a Lycopodium species, *Huperzia* species, and *Phlegmariurus* species. In this manner, methods such as PCR, hybridization, and the like can be used to identify such sequences based on their sequence homology to the sequences set forth herein. Sequences that are selected based on their sequence identity to the entire sequences set forth herein or to fragments thereof are encompassed by the embodiments. Such sequences include sequences that are orthologs of the disclosed sequences. The term "orthologs" refers to genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

In a PCR approach, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook, et al., (1989) *Molecular Cloning: A Laboratory Manual* (2d ed., Cold Spring Harbor Laboratory Press, Plainview, N.Y.), hereinafter "Sambrook". See also, Innis, et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

To identify potential IPD113 polypeptides from fern or other primitive plants, the fern or other primitive plant cell lysates can be screened with antibodies generated against an IPD113 polypeptides and/or IPD113 polypeptides using Western blotting and/or ELISA methods. This type of assays can be performed in a high throughput fashion. Positive samples can be further analyzed by various techniques such as antibody based protein purification and identification.

Alternatively, mass spectrometry based protein identification method can be used to identify homologs of IPD113 polypeptides using protocols such as LC-MS/MS based protein identification method is used to associate the MS data of given cell lysate or desired molecular weight enriched samples (excised from SDS-PAGE gel of relevant molecular weight bands to IPD113 polypeptides) with sequence information of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495, and their homologs. Any match in peptide sequences indicates the potential of having the homologous proteins in the samples. Additional techniques (protein purification and molecular biology) can be used to isolate the protein and identify the sequences of the homologs.

In hybridization methods, all or part of the pesticidal nucleic acid sequence can be used to screen cDNA or genomic libraries. The so-called hybridization probes may be genomic DNA fragments, cDNA fragments, RNA fragments or other oligonucleotides and may be labeled with a detectable group such as 32P or any other detectable marker, such as other radioisotopes, a fluorescent compound, an enzyme or an enzyme co-factor. Probes for hybridization can be made by labeling synthetic oligonucleotides based on the known IPD113 polypeptide-encoding nucleic acid sequence disclosed herein. Degenerate primers designed based on conserved nucleotides or amino acid residues in the nucleic acid sequence or encoded amino acid sequence can additionally be used. The probe typically comprises a region of nucleic acid sequence that hybridizes under stringent conditions to at least about 12, at least about 25, at least about 50, 75, 100, 125, 150, 175 or 200 consecutive nucleotides of nucleic acid sequence encoding an IPD113 polypeptide of the disclosure or a fragment or variant thereof.

For example, an entire nucleic acid sequence, encoding an IPD113 polypeptide, disclosed herein or one or more portions thereof may be used as a probe capable of specifically hybridizing to corresponding nucleic acid sequences encoding IPD113 polypeptide-like sequences and messenger RNAs. To achieve specific hybridization under a variety of conditions, such probes include sequences that are unique and are preferably at least about 10 nucleotides in length or at least about 20 nucleotides in length. Such probes may be used to amplify corresponding pesticidal sequences from a chosen organism by PCR. This technique may be used to isolate additional coding sequences from a desired organism or as a diagnostic assay to determine the presence of coding sequences in an organism. Hybridization techniques include hybridization screening of plated DNA libraries (either plaques or colonies; see, for example, Sambrook, et al., (1989) Molecular Cloning: A Laboratory Manual (2d ed., Cold Spring Harbor Laboratory Press, Cold Spring Harbor, N.Y.).

Hybridization of such sequences may be carried out under stringent conditions. "Stringent conditions" or "stringent hybridization conditions" is used herein to refer to conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 nucleotides in length, preferably less than 500 nucleotides in length Compositions Compositions comprising at least one IPD113 polypeptide or IPD113 chimeric polypeptide of the disclosure are also embraced.

Antibodies

Antibodies to an IPD113 polypeptide of the embodiments or to variants or fragments thereof are also encompassed. The antibodies of the disclosure include polyclonal and monoclonal antibodies as well as fragments thereof which retain their ability to bind to an IPD113 polypeptide found in the insect gut. An antibody, monoclonal antibody or fragment thereof is said to be capable of binding a molecule if it is capable of specifically reacting with the molecule to thereby bind the molecule to the antibody, monoclonal antibody or fragment thereof. The term "antibody" (Ab) or "monoclonal antibody" (Mab) is meant to include intact molecules as well as fragments or binding regions or domains thereof (such as, for example, Fab and F(ab).sub.2 fragments) which are capable of binding hapten. Such fragments are typically produced by proteolytic cleavage, such as papain or pepsin. Alternatively, hapten-binding fragments can be produced through the application of recombinant DNA technology or through synthetic chemistry.

A kit for detecting the presence of an IPD113 polypeptide or detecting the presence of a nucleotide sequence encoding an IPD113 polypeptide in a sample is provided. In one embodiment, the kit provides antibody-based reagents for detecting the presence of an IPD113 polypeptide in a tissue sample. In another embodiment, the kit provides labeled nucleic acid probes useful for detecting the presence of one or more polynucleotides encoding an IPD113 polypeptide. The kit is provided along with appropriate reagents and controls for carrying out a detection method, as well as instructions for use of the kit.

Receptor Identification and Isolation

Receptors to the IPD113 polypeptide of the embodiments or to variants or fragments thereof are also encompassed. Methods for identifying receptors can be employed to identify and isolate the receptor that recognizes the IPD113 polypeptide using the brush-border membrane vesicles from susceptible insects. In addition to the radioactive labeling method listed in the cited literatures, an IPD113 polypeptide can be labeled with fluorescent dye and other common labels such as streptavidin. Brush-border membrane vesicles (BBMV) of susceptible insects such as soybean looper and stink bugs can be prepared according to the protocols listed in the references and separated on SDS-PAGE gel and blotted on suitable membrane. Labeled IPD113 polypeptide can be incubated with blotted membrane of BBMV and labeled IPD113 polypeptide can be identified with the labeled reporters. Identification of protein band(s) that interact with the IPD113 polypeptide can be detected by N-terminal amino acid gas phase sequencing or mass spectrometry based protein identification method (Patterson, (1998) 10.22, 1-24, Current Protocol in Molecular Biology published by John Wiley & Son Inc). Once the protein is identified, the corresponding gene can be cloned from genomic DNA or cDNA library of the susceptible insects and binding affinity can be measured directly with the IPD113 polypeptide. Receptor function for insecticidal activity by the IPD113 polypeptide can be verified by accomplished by RNAi type of gene knock out method (Rajagopal, et al., (2002) *J. Biol. Chem.* 277:46849-46851).

Nucleotide Constructs, Expression Cassettes and Vectors

The use of the term "nucleotide constructs" herein is not intended to limit the embodiments to nucleotide constructs comprising DNA. Those of ordinary skill in the art will recognize that nucleotide constructs particularly polynucleotides and oligonucleotides composed of ribonucleotides and combinations of ribonucleotides and deoxyribonucleotides may also be employed in the methods disclosed herein. The nucleotide constructs, nucleic acids, and nucleotide sequences of the embodiments additionally encompass all complementary forms of such constructs, molecules, and sequences. Further, the nucleotide constructs, nucleotide molecules, and nucleotide sequences of the embodiments encompass all nucleotide constructs, molecules, and sequences which can be employed in the methods of the embodiments for transforming plants including, but not limited to, those comprised of deoxyribonucleotides, ribonucleotides, and combinations thereof. Such deoxyribonucleotides and ribonucleotides include both naturally occurring molecules and synthetic analogues. The nucleotide constructs, nucleic acids, and nucleotide sequences of the embodiments also encompass all forms of nucleotide constructs including, but not limited to, single-stranded forms, double-stranded forms, hairpins, stem-and-loop structures and the like.

A further embodiment relates to a transformed organism such as an organism selected from plant and insect cells, bacteria, yeast, baculovirus, protozoa, nematodes and algae. The transformed organism comprises a DNA molecule of the embodiments, an expression cassette comprising the DNA molecule or a vector comprising the expression cassette, which may be stably incorporated into the genome of the transformed organism.

The sequences of the embodiments are provided in DNA constructs for expression in the organism of interest. The construct will include 5' and 3' regulatory sequences operably linked to a sequence of the embodiments. The term "operably linked" as used herein refers to a functional linkage between a promoter and a second sequence, wherein the promoter sequence initiates and mediates transcription of the DNA sequence corresponding to the second sequence. Generally, operably linked means that the nucleic acid sequences being linked are contiguous and where necessary to join two protein coding regions in the same reading frame. The construct may additionally contain at least one additional gene to be cotransformed into the organism. Alternatively, the additional gene(s) can be provided on multiple DNA constructs.

Such a DNA construct is provided with a plurality of restriction sites for insertion of the IPD113 polypeptide gene sequence of the disclosure to be under the transcriptional regulation of the regulatory regions. The DNA construct may additionally contain selectable marker genes.

The DNA construct will generally include in the 5' to 3' direction of transcription: a transcriptional and translational initiation region (i.e., a promoter), a DNA sequence of the embodiments, and a transcriptional and translational termination region (i.e., termination region) functional in the organism serving as a host. The transcriptional initiation region (i.e., the promoter) may be native, analogous, foreign or heterologous to the host organism and/or to the sequence of the embodiments. Additionally, the promoter may be the natural sequence or alternatively a synthetic sequence. The term "foreign" as used herein indicates that the promoter is not found in the native organism into which the promoter is introduced. Where the promoter is "foreign" or "heterologous" to the sequence of the embodiments, it is intended that the promoter is not the native or naturally occurring promoter for the operably linked sequence of the embodiments. As used herein, a chimeric gene comprises a coding sequence operably linked to a transcription initiation region that is heterologous to the coding sequence. Where the promoter is a native or natural sequence, the expression of the operably linked sequence is altered from the wild-type expression, which results in an alteration in phenotype.

In some embodiments, the DNA construct comprises a polynucleotide encoding an IPD113 polypeptide of the embodiments.

In some embodiments, the DNA construct comprises a polynucleotide encoding a chimeric IPD113 polypeptide of the embodiments.

In some embodiments, the DNA construct comprises a polynucleotide encoding a fusion protein comprising an IPD113 polypeptide of the embodiments.

In some embodiments, the DNA construct comprises a polynucleotide comprising a first coding sequence encoding the N-terminal Region of a first IPD113 polypeptide of the disclosure and a second coding sequence encoding the C-terminal Region of a second IPD113 polypeptide of the disclosure.

In some embodiments, the DNA construct may also include a transcriptional enhancer sequence. As used herein, the term an "enhancer" refers to a DNA sequence which can stimulate promoter activity, and may be an innate element of the promoter or a heterologous element inserted to enhance the level or tissue-specificity of a promoter. Various enhancers including for example, introns with gene expression enhancing properties in plants (US Patent Application Publication Number 2009/0144863, the ubiquitin intron (i.e., the maize ubiquitin intron 1 (see, for example, NCBI sequence S94464)), the omega enhancer or the omega prime enhancer (Gallie, et al., (1989) *Molecular Biology of RNA* ed. Cech (Liss, New York) 237-256 and Gallie, et al., (1987) *Gene* 60:217-25), the CaMV 35S enhancer (see, e.g., Benfey, et al., (1990) *EMBO J.* 9:1685-96) and the enhancers of U.S. Pat. No. 7,803,992 may also be used, each of which is incorporated by reference. The above list of transcriptional enhancers is not meant to be limiting. Any appropriate transcriptional enhancer can be used in the embodiments.

The termination region may be native with the transcriptional initiation region, may be native with the operably linked DNA sequence of interest, may be native with the plant host or may be derived from another source (i.e., foreign or heterologous to the promoter, the sequence of interest, the plant host or any combination thereof).

Convenient termination regions are available from the Ti-plasmid of *A. tumefaciens*, such as the octopine synthase and nopaline synthase termination regions. See also, Guerineau, et al., (1991) *Mol. Gen. Genet.* 262:141-144; Proudfoot, (1991) *Cell* 64:671-674; Sanfacon, et al., (1991) *Genes Dev.* 5:141-149; Mogen, et al., (1990) *Plant Cell* 2:1261-1272; Munroe, et al., (1990) *Gene* 91:151-158; Ballas, et al., (1989) *Nucleic Acids Res.* 17:7891-7903 and Joshi, et al., (1987) *Nucleic Acid Res.* 15:9627-9639.

Where appropriate, a nucleic acid may be optimized for increased expression in the host organism. Thus, where the host organism is a plant, the synthetic nucleic acids can be synthesized using plant-preferred codons for improved expression. See, for example, Campbell and Gowri, (1990) *Plant Physiol.* 92:1-11 for a discussion of host-preferred usage. For example, although nucleic acid sequences of the embodiments may be expressed in both monocotyledonous and dicotyledonous plant species, sequences can be modified to account for the specific preferences and GC content preferences of monocotyledons or dicotyledons as these preferences have been shown to differ (Murray et al. (1989) *Nucleic Acids Res.* 17:477-498). Thus, the maize-preferred codon fora particular amino acid may be derived from known gene sequences from maize. Maize usage for 28 genes from maize plants is listed in Table 4 of Murray, et al., supra. Methods are available in the art for synthesizing plant-preferred genes. See, for example, Murray, et al., (1989) *Nucleic Acids Res.* 17:477-498, and Liu H et al. *Mol Bio Rep* 37:677-684, 2010, herein incorporated by reference. A *Zea* maize usage table can be also found at kazusa.or.jp// cgi-bin/show.cgi?species=4577, which can be accessed using the www prefix.

A *Glycine max* usage table can be found at kazusa.or.jp// cgi-bin/show.cgi?species=3847&aa=1&style=N, which can be accessed using the www prefix.

In some embodiments, the recombinant nucleic acid molecule encoding an IPD113 polypeptide has maize optimized codons.

Additional sequence modifications can enhance gene expression in a cellular host. These include elimination of sequences encoding spurious polyadenylation signals, exon-intron splice site signals, transposon-like repeats, and other well-characterized sequences that may be deleterious to gene expression. The GC content of the sequence may be adjusted to levels average for a given cellular host, as calculated by reference to known genes expressed in the host cell. The term "host cell" as used herein refers to a cell which contains a vector and supports the replication and/or expression of the expression vector is intended. Host cells may be prokaryotic cells such as *E. coli* or eukaryotic cells such as yeast, insect, amphibian or mammalian cells or monocotyledonous or dicotyledonous plant cells. An example of a monocotyledonous host cell is a maize host cell. When possible, the sequence is modified to avoid predicted hairpin secondary mRNA structures.

The expression cassettes may additionally contain 5' leader sequences. Such leader sequences can act to enhance translation. Translation leaders include: picornavirus leaders, for example, EMCV leader (Encephalomyocarditis 5' noncoding region) (Elroy-Stein, et al., (1989) *Proc. Natl. Acad. Sci. USA* 86:6126-6130); potyvirus leaders, for example, TEV leader (Tobacco Etch Virus) (Gallie, et al., (1995) *Gene* 165(2):233-238), MDMV leader (Maize Dwarf Mosaic Virus), human immunoglobulin heavy-chain binding protein (BiP) (Macejak, et al., (1991) *Nature* 353:90-94); untranslated leader from the coat protein mRNA of alfalfa mosaic virus (AMV RNA 4) (Jobling, et al., (1987) *Nature* 325:622-625); tobacco mosaic virus leader (TMV) (Gallie, et al., (1989) in *Molecular Biology of RNA*, ed. Cech (Liss, New York), pp. 237-256) and maize chlorotic mottle virus leader (MCMV) (Lommel, et al., (1991) *Virology* 81:382-385). See also, Della-Cioppa, et al., (1987) *Plant Physiol.* 84:965-968. Such constructs may also contain a "signal sequence" or "leader sequence" to facilitate co-translational or post-translational transport of the peptide to certain intracellular structures such as the chloroplast (or other plastid), endoplasmic reticulum or Golgi apparatus.

"Signal sequence" as used herein refers to a sequence that is known or suspected to result in cotranslational or post-translational peptide transport across the cell membrane. In eukaryotes, this typically involves secretion into the Golgi apparatus, with some resulting glycosylation. Insecticidal toxins of bacteria are often synthesized as protoxins, which are proteolytically activated in the gut of the target pest (Chang, (1987) *Methods Enzymol.* 153:507-516). In some embodiments, the signal sequence is in the native sequence or may be derived from a sequence of the embodiments. "Leader sequence" as used herein refers to any sequence that when translated, results in an amino acid sequence sufficient to trigger co-translational transport of the peptide chain to a subcellular organelle. Thus, this includes leader sequences targeting transport and/or glycosylation by passage into the endoplasmic reticulum, passage to vacuoles, plastids including chloroplasts, mitochondria, and the like. Nuclear-encoded proteins targeted to the chloroplast thylakoid lumen compartment have a characteristic bipartite transit peptide, composed of a stromal targeting signal peptide and a lumen targeting signal peptide. The stromal targeting information is in the amino-proximal portion of the transit peptide. The lumen targeting signal peptide is in the carboxyl-proximal portion of the transit peptide, and contains all the information for targeting to the lumen. Recent research in proteomics of the higher plant chloroplast has achieved in the identification of numerous nuclear-encoded lumen proteins (Kieselbach et al. *FEBS LETT* 480:271-276, 2000; Peltier et al. *Plant Cell* 12:319-341, 2000; Bricker et al. *Biochim. Biophys Acta* 1503:350-356, 2001), the lumen targeting signal peptide of which can potentially be used in accordance with the present disclosure. About 80 proteins from *Arabidopsis*, as well as homologous proteins from spinach and garden pea, are reported by Kieselbach et al., *Photosynthesis Research*, 78:249-264, 2003. Table 2 of this publication, which is incorporated into the description herewith by reference, discloses 85 proteins from the chloroplast lumen, identified by their accession number (see also US Patent Application Publication 2009/09044298). In addition, the recently published draft version of the rice genome (Goff et al, *Science* 296:92-100, 2002) is a suitable source for lumen targeting signal peptide which may be used in accordance with the present disclosure.

Suitable chloroplast transit peptides (CTP) include chimeric CT's comprising but not limited to, an N-terminal domain, a central domain or a C-terminal domain from a CTP from *Oryza sativa* 1-decoy-D xylose-5-Phosphate Synthase *Oryza sativa*-Superoxide dismutase *Oryza sativa*-soluble starch synthase *Oryza sativa*-NADP-dependent Malic acid enzyme *Oryza sativa*-Phospho-2-dehydro-3-deoxyheptonate Aldolase 2 *Oryza sativa*-L-Ascorbate peroxidase 5 *Oryza sativa*-Phosphoglucan water dikinase, *Zea Mays* ssRUBISCO, *Zea Mays*-beta-glucosidase, *Zea Mays*-Malate dehydrogenase, *Zea Mays* Thioredoxin M-type US Patent Application Publication 2012/0304336).

The IPD113 polypeptide gene to be targeted to the chloroplast may be optimized for expression in the chloroplast to account for differences in usage between the plant nucleus and this organelle. In this manner, the nucleic acids of interest may be synthesized using chloroplast-preferred sequences.

In preparing the expression cassette, the various DNA fragments may be manipulated to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites or the like. For this purpose, in vitro mutagenesis, primer repair, restriction, annealing, resubstitutions, e.g., transitions and transversions, may be involved.

Several promoters can be used in the practice of the embodiments. The promoters can be selected based on the desired outcome. The nucleic acids can be combined with constitutive, tissue-preferred, inducible or other promoters for expression in the host organism. Suitable constitutive promoters for use in a plant host cell include, for example, the core promoter of the Rsyn7 promoter and other constitutive promoters disclosed in WO 1999/43838 and U.S. Pat. No. 6,072,050; the core CaMV 35S promoter (Odell, et al., (1985) *Nature* 313:810-812); rice actin (McElroy, et al., (1990) *Plant Cell* 2:163-171); ubiquitin (Christensen, et al., (1989) *Plant Mol. Biol.* 12:619-632 and Christensen, et al., (1992) *Plant Mol. Biol.* 18:675-689); pEMU (Last, et al., (1991) *Theor. Appl. Genet.* 81:581-588); MAS (Velten, et al., (1984) *EMBO J.* 3:2723-2730); ALS promoter (U.S. Pat. No. 5,659,026) and the like. Other constitutive promoters include, for example, those discussed in U.S. Pat. Nos. 5,608,149; 5,608,144; 5,604,121; 5,569,597; 5,466,785; 5,399,680; 5,268,463; 5,608,142 and 6,177,611.

Depending on the desired outcome, it may be beneficial to express the gene from an inducible promoter. Of particular interest for regulating the expression of the nucleotide sequences of the embodiments in plants are wound-inducible promoters. Such wound-inducible promoters, may respond to damage caused by insect feeding, and include potato proteinase inhibitor (pin II) gene (Ryan, (1990) *Ann. Rev. Phytopath.* 28:425-449; Duan, et al., (1996) *Nature Biotechnology* 14:494-498); wun1 and wun2, U.S. Pat. No. 5,428,148; win1 and win2 (Stanford, et al., (1989) *Mol. Gen. Genet.* 215:200-208); systemin (McGurl, et al., (1992) *Science* 225:1570-1573); WIP1 (Rohmeier, et al., (1993) *Plant Mol. Biol.* 22:783-792; Eckelkamp, et al., (1993) *FEBS Letters* 323:73-76); MPI gene (Corderok, et al., (1994) *Plant J.* 6(2):141-150) and the like, herein incorporated by reference.

Additionally, pathogen-inducible promoters may be employed in the methods and nucleotide constructs of the embodiments. Such pathogen-inducible promoters include those from pathogenesis-related proteins (PR proteins), which are induced following infection by a pathogen; e.g., PR proteins, SAR proteins, beta-1,3-glucanase, chitinase, etc. See, for example, Redolfi, et al., (1983) *Neth. J. Plant Pathol.* 89:245-254; Uknes, et al., (1992) *Plant Cell* 4: 645-656 and Van Loon, (1985) *Plant Mol. Virol.* 4:111-116. See also, WO 1999/43819, herein incorporated by reference.

Of interest are promoters that are expressed locally at or near the site of pathogen infection. See, for example, Marineau, et al., (1987) *Plant Mol. Biol.* 9:335-342; Matton, et al., (1989) *Molecular Plant-Microbe Interactions* 2:325-331; Somsisch, et al., (1986) *Proc. Natl. Acad. Sci. USA* 83:2427-2430; Somsisch, et al., (1988) *Mol. Gen. Genet.* 2:93-98 and Yang, (1996) *Proc. Natl. Acad. Sci. USA* 93:14972-14977. See also, Chen, et al., (1996) *Plant J.* 10:955-966; Zhang, et al., (1994) *Proc. Natl. Acad. Sci. USA* 91:2507-2511; Warner, et al., (1993) *Plant J.* 3:191-201; Siebertz, et al., (1989) *Plant Cell* 1:961-968; U.S. Pat. No. 5,750,386 (nematode-inducible) and the references cited therein. Of particular interest is the inducible promoter for the maize PRms gene, whose expression is induced by the pathogen *Fusarium moniliforme* (see, for example, Cordero, et al., (1992) *Physiol. Mol. Plant Path.* 41:189-200).

Chemical-regulated promoters can be used to modulate the expression of a gene in a plant through the application of an exogenous chemical regulator. Depending upon the objective, the promoter may be a chemical-inducible promoter, where application of the chemical induces gene expression or a chemical-repressible promoter, where application of the chemical represses gene expression. Chemical-inducible promoters include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena, et al., (1991) *Proc. Natl. Acad. Sci. USA* 88:10421-10425 and McNellis, et al., (1998) *Plant J.* 14(2):247-257) and tetracycline-inducible and tetracycline-repressible promoters (see, for example, Gatz, et al., (1991) *Mol. Gen. Genet.* 227:229-237 and U.S. Pat. Nos. 5,814,618 and 5,789,156), herein incorporated by reference.

Tissue-preferred promoters can be utilized to target enhanced an IPD113 polypeptide expression within a particular plant tissue. Tissue-preferred promoters include those discussed in Yamamoto, et al., (1997) *Plant J.* 12(2) 255-265; Kawamata, et al., (1997) *Plant Cell Physiol.* 38(7): 792-803; Hansen, et al., (1997) *Mol. Gen Genet.* 254(3): 337-343; Russell, et al., (1997) *Transgenic Res.* 6(2):157-168; Rinehart, et al., (1996) *Plant Physiol.* 112(3): 1331-1341; Van Camp, et al., (1996) *Plant Physiol.* 112(2):525-535; Canevascini, et al., (1996) *Plant Physiol.* 112(2):513-524; Yamamoto, et al., (1994) *Plant Cell Physiol.* 35(5): 773-778; Lam, (1994) *Results Probl. Cell Differ.* 20:181-196; Orozco, et al., (1993) *Plant Mol Biol.* 23(6): 1129-1138; Matsuoka, et al., (1993) *Proc Natl. Acad. Sci. USA* 90(20):9586-9590 and Guevara-Garcia, et al., (1993) *Plant J.* 4(3):495-505. Such promoters can be modified, if necessary, for weak expression.

Leaf-preferred promoters are known in the art. See, for example, Yamamoto, et al., (1997) *Plant J.* 12(2):255-265; Kwon, et al., (1994) *Plant Physiol.* 105:357-67; Yamamoto, et al., (1994) *Plant Cell Physiol.* 35(5):773-778; Gotor, et al., (1993) *Plant J.* 3:509-18; Orozco, et al., (1993) *Plant Mol. Biol.* 23(6):1129-1138 and Matsuoka, et al., (1993) *Proc. Natl. Acad. Sci. USA* 90(20):9586-9590.

Root-preferred or root-specific promoters can be selected from the many available from the literature or isolated de novo from various compatible species. See, for example, Hire, et al., (1992) *Plant Mol. Biol.* 20(2):207-218 (soybean root-specific glutamine synthetase gene); Keller and Baumgartner, (1991) *Plant Cell* 3(10):1051-1061 (root-specific control element in the GRP 1.8 gene of French bean); Sanger, et al., (1990) *Plant Mol. Biol.* 14(3):433-443 (root-specific promoter of the mannopine synthase (MAS) gene of *Agrobacterium tumefaciens*) and Miao, et al., (1991) *Plant Cell* 3(1):11-22 (full-length cDNA clone encoding cytosolic glutamine synthetase (GS), which is expressed in roots and root nodules of soybean). See also, Bogusz, et al., (1990) *Plant Cell* 2(7):633-641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a β-glucuronidase reporter gene and introduced into both the nonlegume *Nicotiana tabacum* and the legume *Lotus corniculatus*, and in both instances root-specific promoter activity was preserved. Leach and Aoyagi, (1991) describe their analysis of the promoters of the highly expressed rolC and rolD root-inducing genes of *Agrobacterium rhizogenes* (see, Plant Science (Limerick) 79(1):69-76). They concluded that enhancer and tissue-preferred DNA determinants are dissociated in those promoters. Teeri, et al., (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see, *EMBO J.* 8(2): 343-350). The TR1' gene fused to nptII (neomycin phosphotransferase II) showed similar characteristics. Additional root-preferred promoters include the VfENOD-GRP3 gene promoter (Kuster, et al., (1995) *Plant Mol. Biol.* 29(4):759-772) and rolB promoter (Capana, et al., (1994) *Plant Mol. Biol.* 25(4):681-691. See also, U.S. Pat. Nos. 5,837,876; 5,750,386; 5,633,363; 5,459,252; 5,401,836; 5,110,732 and 5,023,179. *Arabidopsis thaliana* root-preferred regulatory sequences are disclosed in US20130117883.

"Seed-preferred" promoters include both "seed-specific" promoters (those promoters active during seed development such as promoters of seed storage proteins) as well as "seed-germinating" promoters (those promoters active during seed germination). See, Thompson, et al., (1989) *BioEssays* 10:108, herein incorporated by reference. Such seed-preferred promoters include, but are not limited to, Cim1 (cytokinin-induced message); cZ19B1 (maize 19 kDa zein); and milps (myo-inositol-1-phosphate synthase) (see, U.S. Pat. No. 6,225,529, herein incorporated by reference). Gamma-zein and Glb-1 are endosperm-specific promoters. For dicots, seed-specific promoters include, but are not limited to, Kunitz trypsin inhibitor 3 (KTi3) (Jofuku and Goldberg, (1989) *Plant Cell* 1:1079-1093), bean β-phaseolin, napin, β-conglycinin, glycinin 1, soybean lectin, cruciferin, and the like. For monocots, seed-specific promoters include, but are not limited to, maize 15 kDa zein, 22 kDa zein, 27 kDa zein, g-zein, waxy, shrunken 1, shrunken 2, globulin 1, etc. See also, WO 2000/12733, where seed-preferred promoters from end1 and end2 genes are disclosed; herein incorporated by reference. In dicots, seed specific promoters include but are not limited to seed coat promoter from *Arabidopsis*, pBAN; and the early seed promoters from *Arabidopsis*, p26, p63, and p63tr (U.S. Pat. Nos. 7,294,760 and 7,847,153). A promoter that has "preferred" expression in a particular tissue is expressed in that tissue to a greater degree than in at least one other plant tissue. Some tissue-preferred promoters show expression almost exclusively in the particular tissue.

Where low level expression is desired, weak promoters will be used. Generally, the term "weak promoter" as used herein refers to a promoter that drives expression of a coding sequence at a low level. By low level expression at levels of between about 1/1000 transcripts to about 1/100,000 transcripts to about 1/500,000 transcripts is intended. Alternatively, it is recognized that the term "weak promoters" also encompasses promoters that drive expression in only a few cells and not in others to give a total low level of expression. Where a promoter drives expression at unacceptably high levels, portions of the promoter sequence can be deleted or modified to decrease expression levels.

Such weak constitutive promoters include, for example the core promoter of the Rsyn7 promoter (WO 1999/43838 and U.S. Pat. No. 6,072,050), the core 35S CaMV promoter, and the like. Other constitutive promoters include, for example, those disclosed in U.S. Pat. Nos. 5,608,149; 5,608,144; 5,604,121; 5,569,597; 5,466,785; 5,399,680; 5,268,463; 5,608,142 and 6,177,611, herein incorporated by reference.

The above list of promoters is not meant to be limiting. Any appropriate promoter can be used in the embodiments.

Generally, the expression cassette will comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones and 2,4-dichlorophenoxyacetate (2,4-D). Additional examples of suitable selectable marker genes include, but are not limited to, genes encoding resistance to chloramphenicol (Herrera Estrella, et al., (1983) *EMBO J.* 2:987-992); methotrexate (Herrera Estrella, et al., (1983) *Nature* 303:209-213 and Meijer, et al., (1991) *Plant Mol. Biol.* 16:807-820); streptomycin (Jones, et al., (1987) *Mol. Gen. Genet.* 210:86-91); spectinomycin (Bretagne-Sagnard, et al., (1996) *Transgenic Res.* 5:131-137); bleomycin (Hille, et al., (1990) *Plant Mol. Biol.* 7:171-176); sulfonamide (Guerineau, et al., (1990) *Plant Mol. Biol.* 15:127-136); bromoxynil (Stalker, et al., (1988) *Science* 242:419-423); glyphosate (Shaw, et al., (1986) *Science* 233:478-481 and U.S. patent application Ser. Nos. 10/004,357 and 10/427,692); phosphinothricin (DeBlock, et al., (1987) *EMBO J.* 6:2513-2518). See generally, Yarranton, (1992) *Curr. Opin. Biotech.* 3:506-511; Christopherson, et al., (1992) *Proc. Natl. Acad. Sci. USA* 89:6314-6318; Yao, et al., (1992) *Cell* 71:63-72; Reznikoff, (1992) *Mol. Microbiol.* 6:2419-2422; Barkley, et al., (1980) in *The Operon*, pp. 177-220; Hu, et al., (1987) *Cell* 48:555-566; Brown, et al., (1987) *Cell* 49:603-612; Figge, et al., (1988) *Cell* 52:713-722; Deuschle, et al., (1989) *Proc. Natl. Acad. Sci. USA* 86:5400-5404; Fuerst, et al., (1989) *Proc. Natl. Acad. Sci. USA* 86:2549-2553; Deuschle, et al., (1990) *Science* 248:480-483; Gossen, (1993) Ph.D. Thesis, University of Heidelberg; Reines, et al., (1993) *Proc. Natl. Acad. Sci. USA* 90:1917-1921; Labow, et al., (1990) *Mol. Cell. Biol.* 10:3343-3356; Zambretti, et al., (1992) *Proc. Natl. Acad. Sci. USA* 89:3952-3956; Baim, et al., (1991) *Proc. Natl. Acad. Sci. USA* 88:5072-5076; Wyborski, et al., (1991) *Nucleic Acids Res.* 19:4647-4653; Hillenand-Wissman, (1989) *Topics Mol. Struc. Biol.* 10:143-162; Degenkolb, et al., (1991) *Antimicrob. Agents Chemother.* 35:1591-1595; Kleinschnidt, et al., (1988) *Biochemistry* 27:1094-1104; Bonin, (1993) Ph.D. Thesis, University of Heidelberg; Gossen, et al., (1992) *Proc. Natl. Acad. Sci. USA* 89:5547-5551; Oliva, et al., (1992) *Antimicrob. Agents Chemother.* 36:913-919; Hlavka, et al., (1985) *Handbook of Experimental Pharmacology*, Vol. 78 (Springer-Verlag, Berlin) and Gill, et al., (1988) *Nature* 334:721-724. Such disclosures are herein incorporated by reference.

The above list of selectable marker genes is not meant to be limiting. Any selectable marker gene can be used in the embodiments.

Plant Transformation

The methods of the embodiments involve introducing a polypeptide or polynucleotide into a plant. "Introducing" is as used herein means presenting to the plant the polynucleotide or polypeptide in such a manner that the sequence gains access to the interior of a cell of the plant. The methods of the embodiments do not depend on a particular method for introducing a polynucleotide or polypeptide into a plant, only that the polynucleotide or polypeptides gains access to the interior of at least one cell of the plant. Methods for introducing polynucleotide or polypeptides into plants including, but not limited to, stable transformation methods, transient transformation methods, and virus-mediated methods.

"Stable transformation" is as used herein means that the nucleotide construct introduced into a plant integrates into the genome of the plant and is capable of being inherited by the progeny thereof. "Transient transformation" as used herein means that a polynucleotide is introduced into the plant and does not integrate into the genome of the plant or a polypeptide is introduced into a plant. "Plant" as used herein refers to whole plants, plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells and pollen).

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway, et al., (1986) *Biotechniques* 4:320-334), electroporation (Riggs, et al., (1986) *Proc. Natl. Acad. Sci. USA* 83:5602-5606), *Agrobacterium*-mediated transformation (U.S. Pat. Nos. 5,563,055 and 5,981,840), direct gene transfer (Paszkowski, et al., (1984) *EMBO J.* 3:2717-2722) and ballistic particle acceleration (see, for example, U.S. Pat. Nos. 4,945,050; 5,879,918; 5,886,244 and 5,932,782; Tomes, et al., (1995) in Plant Cell, Tissue, and Organ Culture: Fundamental Methods, ed. Gamborg and Phillips, (Springer-Verlag, Berlin) and McCabe, et al., (1988) *Biotechnology* 6:923-926) and Lecl transformation (WO 00/28058). For potato transformation see, Tu, et al., (1998) *Plant Molecular Biology* 37:829-838 and Chong, et al., (2000) *Transgenic* Research 9:71-78. Additional transformation procedures can be found in Weissinger, et al., (1988) *Ann. Rev. Genet.* 22:421-477; Sanford, et al., (1987) *Particulate Science and Technology* 5:27-37 (onion); Christou, et al., (1988) *Plant Physiol.* 87:671-674 (soybean); McCabe, et al., (1988) *Bio/Technology* 6:923-926 (soybean); Finer and McMullen, (1991) *In Vitro Cell Dev. Biol.* 27P:175-182 (soybean); Singh, et al., (1998) *Theor. Appl. Genet.* 96:319-

324 (soybean); Datta, et al., (1990) *Biotechnology* 8:736-740 (rice); Klein, et al., (1988) *Proc. Natl. Acad. Sci. USA* 85:4305-4309 (maize); Klein, et al., (1988) *Biotechnology* 6:559-563 (maize); U.S. Pat. Nos. 5,240,855; 5,322,783 and 5,324,646; Klein, et al., (1988) *Plant Physiol.* 91:440-444 (maize); Fromm, et al., (1990) *Biotechnology* 8:833-839 (maize); Hooykaas-Van Slogteren, et al., (1984) *Nature* (London) 311:763-764; U.S. Pat. No. 5,736,369 (cereals); Bytebier, et al., (1987) *Proc. Natl. Acad. Sci. USA* 84:5345-5349 (Liliaceae); De Wet, et al., (1985) in The Experimental Manipulation of Ovule Tissues, ed. Chapman, et al., (*Longman*, New York), pp. 197-209 (pollen); Kaeppler, et al., (1990) *Plant* Cell Reports 9:415-418 and Kaeppler, et al., (1992) *Theor. Appl. Genet.* 84:560-566 (whisker-mediated transformation); D'Halluin, et al., (1992) *Plant Cell* 4:1495-1505 (electroporation); Li, et al., (1993) *Plant Cell Reports* 12:250-255 and Christou and Ford, (1995) *Annals of Botany* 75:407-413 (rice); Osjoda, et al., (1996) *Nature Biotechnology* 14:745-750 (maize via *Agrobacterium tumefaciens*); all of which are herein incorporated by reference.

In specific embodiments, the sequences of the embodiments can be provided to a plant using a variety of transient transformation methods. Such transient transformation methods include, but are not limited to, the introduction of the IPD113 polynucleotide or variants and fragments thereof directly into the plant or the introduction of the IPD113 polypeptide transcript into the plant. Such methods include, for example, microinjection or particle bombardment. See, for example, Crossway, et al., (1986) *Mol Gen. Genet.* 202:179-185; Nomura, et al., (1986) *Plant Sci.* 44:53-58; Hepler, et al., (1994) *Proc. Natl. Acad. Sci.* 91:2176-2180 and Hush, et al., (1994) *The Journal of Cell Science* 107: 775-784, all of which are herein incorporated by reference. Alternatively, the IPD113 polynucleotide can be transiently transformed into the plant. Such techniques include viral vector system and the precipitation of the polynucleotide in a manner that precludes subsequent release of the DNA. Thus, transcription from the particle-bound DNA can occur, but the frequency with which it is released to become integrated into the genome is greatly reduced. Such methods include the use of particles coated with polyethylimine (PEI; Sigma #P3143).

Methods for the targeted insertion of a polynucleotide at a specific location in the plant genome can be achieved by the insertion of the polynucleotide at a desired genomic location is achieved using a site-specific recombination system. See, for example, WO 1999/25821, WO 1999/25854, WO 1999/25840, WO 1999/25855 and WO 1999/25853, all of which are herein incorporated by reference. Briefly, the polynucleotide of the embodiments can be contained in transfer cassette flanked by two non-identical recombination sites. The transfer cassette is introduced into a plant have stably incorporated into its genome a target site which is flanked by two non-identical recombination sites that correspond to the sites of the transfer cassette. An appropriate recombinase is provided and the transfer cassette is integrated at the target site. The polynucleotide of interest is thereby integrated at a specific chromosomal position in the plant genome.

Plant transformation vectors may be comprised of one or more DNA vectors needed for achieving plant transformation. For example, it is a common practice in the art to utilize plant transformation vectors that are comprised of more than one contiguous DNA segment. These vectors are often referred to in the art as "binary vectors". Binary vectors as well as vectors with helper plasmids are most often used for *Agrobacterium*-mediated transformation, where the size and complexity of DNA segments needed to achieve efficient transformation is quite large, and it is advantageous to separate functions onto separate DNA molecules. Binary vectors typically contain a plasmid vector that contains the cis-acting sequences required for T-DNA transfer (such as left border and right border), a selectable marker that is engineered to be capable of expression in a plant cell, and a "gene of interest" (a gene engineered to be capable of expression in a plant cell for which generation of transgenic plants is desired). Also present on this plasmid vector are sequences required for bacterial replication. The cis-acting sequences are arranged in a fashion to allow efficient transfer into plant cells and expression therein. For example, the selectable marker gene and the pesticidal gene are located between the left and right borders. Often a second plasmid vector contains the trans-acting factors that mediate T-DNA transfer from *Agrobacterium* to plant cells. This plasmid often contains the virulence functions (Vir genes) that allow infection of plant cells by *Agrobacterium*, and transfer of DNA by cleavage at border sequences and vir-mediated DNA transfer, as is understood in the art (Hellens and Mullineaux, (2000) *Trends in Plant Science* 5:446-451). Several types of *Agrobacterium* strains (e.g. LBA4404, GV3101, EHA101, EHA105, etc.) can be used for plant transformation. The second plasmid vector is not necessary for transforming the plants by other methods such as microprojection, microinjection, electroporation, polyethylene glycol, etc.

In general, plant transformation methods involve transferring heterologous DNA into target plant cells (e.g., immature or mature embryos, suspension cultures, undifferentiated callus, protoplasts, etc.), followed by applying a maximum threshold level of appropriate selection (depending on the selectable marker gene) to recover the transformed plant cells from a group of untransformed cell mass. Following integration of heterologous foreign DNA into plant cells, one then applies a maximum threshold level of appropriate selection in the medium to kill the untransformed cells and separate and proliferate the putatively transformed cells that survive from this selection treatment by transferring regularly to a fresh medium. By continuous passage and challenge with appropriate selection, one can identify and proliferate the cells that are transformed with the plasmid vector. Molecular and biochemical methods can then be used to confirm the presence of the integrated heterologous gene of interest into the genome of the transgenic plant.

Explants are typically transferred to a fresh supply of the same medium and cultured routinely. Subsequently, the transformed cells are differentiated into shoots after placing on regeneration medium supplemented with a maximum threshold level of selecting agent. The shoots are then transferred to a selective rooting medium for recovering rooted shoot or plantlet. The transgenic plantlet then grows into a mature plant and produces fertile seeds (e.g., Hiei, et al., (1994) *The Plant Journal* 6:271-282; Ishida, et al., (1996) *Nature Biotechnology* 14:745-750). Explants are typically transferred to a fresh supply of the same medium and cultured routinely. A general description of the techniques and methods for generating transgenic plants are found in Ayres and Park, (1994) *Critical Reviews in Plant Science* 13:219-239 and Bommineni and Jauhar, (1997) *Maydica* 42:107-120. Since the transformed material contains many cells; both transformed and non-transformed cells are present in any piece of subjected target callus or tissue or group of cells. The ability to kill non-transformed cells and allow transformed cells to proliferate results in transformed plant cultures. Often, the ability to remove non-transformed cells is a limitation to rapid recovery of transformed plant cells and successful generation of transgenic plants.

The cells that have been transformed may be grown into plants in accordance with conventional ways. See, for example, McCormick, et al., (1986) *Plant Cell Reports* 5:81-84. These plants may then be grown, and either pollinated with the same transformed strain or different strains, and the resulting hybrid having constitutive or inducible expression of the desired phenotypic characteristic identified. Two or more generations may be grown to ensure that expression of the desired phenotypic characteristic is stably maintained and inherited and then seeds harvested to ensure that expression of the desired phenotypic characteristic has been achieved.

The nucleotide sequences of the embodiments may be provided to the plant by contacting the plant with a virus or viral nucleic acids. Generally, such methods involve incorporating the nucleotide construct of interest within a viral DNA or RNA molecule. It is recognized that the recombinant proteins of the embodiments may be initially synthesized as part of a viral polyprotein, which later may be processed by proteolysis in vivo or in vitro to produce the desired IPD113 polypeptide. It is also recognized that such a viral polyprotein, comprising at least a portion of the amino acid sequence of an IPD113 of the embodiments, may have the desired pesticidal activity. Such viral polyproteins and the nucleotide sequences that encode for them are encompassed by the embodiments. Methods for providing plants with nucleotide constructs and producing the encoded proteins in the plants, which involve viral DNA or RNA molecules. See, for example, U.S. Pat. Nos. 5,889,191; 5,889,190; 5,866,785; 5,589,367 and 5,316,931; herein incorporated by reference.

Methods for transformation of chloroplasts include, for example, Svab, et al., (1990) *Proc. Natl. Acad. Sci. USA* 87:8526-8530; Svab and Maliga, (1993) *Proc. Natl. Acad. Sci. USA* 90:913-917; Svab and Maliga, (1993) *EMBO J.* 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride, et al., (1994) *Proc. Natl. Acad. Sci. USA* 91:7301-7305.

The embodiments further relate to plant-propagating material of a transformed plant of the embodiments including, but not limited to, seeds, tubers, corms, bulbs, leaves and cuttings of roots and shoots.

The embodiments may be used for transformation of any plant species, including, but not limited to, monocots and dicots. Examples of plants of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatas*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum. Conifers that may be employed in practicing the embodiments include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Plants of the embodiments include crop plants (for example, corn, alfalfa, sunflower, *Brassica*, soybean, cotton, safflower, peanut, sorghum, wheat, millet, tobacco, etc.), such as corn and soybean plants.

Turf grasses include, but are not limited to: annual bluegrass (*Poa annus*); annual ryegrass (*Lolium multiflorum*); Canada bluegrass (*Poa compressa*); Chewing's fescue (*Festuca rubra*); colonial bentgrass (*Agrostis tenuis*); creeping bentgrass (*Agrostis palustris*); crested wheatgrass (*Agropyron desertorum*); fairway wheatgrass (*Agropyron cristatum*); hard fescue (*Festuca longifolia*); Kentucky bluegrass (*Poa pratensis*); orchardgrass (*Dactylis glomerata*); perennial ryegrass (*Lolium perenne*); red fescue (*Festuca rubra*); redtop (*Agrostis alba*); rough bluegrass (*Poa trivialis*); sheep fescue (*Festuca ovina*); smooth bromegrass (*Bromus inermis*); tall fescue (*Festuca arundinacea*); timothy (*Phleum pratense*); velvet bentgrass (*Agrostis canina*); weeping alkaligrass (*Puccinellia distans*); western wheatgrass (*Agropyron smithii*); Bermuda grass (*Cynodon* spp.); St. Augustine grass (*Stenotaphrum secundatum*); zoysia grass (*Zoysia* spp.); Bahia grass (*Paspalum notatum*); carpet grass (*Axonopus affinis*); centipede grass (*Eremochloa ophiuroides*); kikuyu grass (*Pennisetum clandesinum*); seashore paspalum (*Paspalum vaginatum*); blue gramma (*Bouteloua gracilis*); buffalo grass (*Buchloe dactyloids*); sideoats gramma (*Bouteloua curtipendula*).

Plants of interest include grain plants that provide seeds of interest, oil-seed plants, and leguminous plants. Seeds of interest include grain seeds, such as corn, wheat, barley, rice, sorghum, rye, millet, etc. Oil-seed plants include cotton, soybean, safflower, sunflower, *Brassica*, maize, alfalfa, palm, coconut, flax, castor, olive, etc. Leguminous plants include beans and peas. Beans include guar, locust bean, fenugreek, soybean, garden beans, cowpea, mung bean, lima bean, fava bean, lentils, chickpea, etc.

Evaluation of Plant Transformation

Following introduction of heterologous foreign DNA into plant cells, the transformation or integration of heterologous gene in the plant genome is confirmed by various methods such as analysis of nucleic acids, proteins and metabolites associated with the integrated gene.

PCR analysis is a rapid method to screen transformed cells, tissue or shoots for the presence of incorporated gene at the earlier stage before transplanting into the soil (Sambrook and Russell, (2001) Molecular Cloning: A Laboratory Manual. Cold Spring Harbor Laboratory Press, Cold Spring Harbor, N.Y.). PCR is carried out using oligonucleotide primers specific to the gene of interest or *Agrobacterium* vector background, etc.

Plant transformation may be confirmed by Southern blot analysis of genomic DNA (Sambrook and Russell, (2001) supra). In general, total DNA is extracted from the transformant, digested with appropriate restriction enzymes, fractionated in an agarose gel and transferred to a nitrocellulose or nylon membrane. The membrane or "blot" is then probed with, for example, radiolabeled 32P target DNA fragment to confirm the integration of introduced gene into the plant genome according to standard techniques (Sambrook and Russell, (2001) supra).

In Northern blot analysis, RNA is isolated from specific tissues of transformant, fractionated in a formaldehyde agarose gel, and blotted onto a nylon filter according to standard procedures that are routinely used in the art (Sambrook and Russell, (2001) supra). Expression of RNA encoded by the pesticidal gene is then tested by hybridizing the filter to a radioactive probe derived from a pesticidal gene (Sambrook and Russell, (2001) supra).

Western blot, biochemical assays and the like may be carried out on the transgenic plants to confirm the presence of protein encoded by the pesticidal gene by standard procedures (Sambrook and Russell, 2001, supra) using antibodies that bind to one or more epitopes present on the IPD113 polypeptide.

Methods to Introduce Genome Editing Technologies into Plants

In some embodiments, the disclosed IPD113 polynucleotide compositions can be introduced into the genome of a plant using genome editing technologies, or previously introduced IPD113 polynucleotides in the genome of a plant may be edited using genome editing technologies. For example, the disclosed polynucleotides can be introduced into a desired location in the genome of a plant through the use of double-stranded break technologies such as TALENs, meganucleases, zinc finger nucleases, CRISPR-Cas, and the like. For example, the disclosed polynucleotides can be introduced into a desired location in a genome using a CRISPR-Cas system, for the purpose of site-specific insertion. The desired location in a plant genome can be any desired target site for insertion, such as a genomic region amenable for breeding or may be a target site located in a genomic window with an existing trait of interest. Existing traits of interest could be either an endogenous trait or a previously introduced trait.

In some embodiments, where the disclosed IPD113 polynucleotide has previously been introduced into a genome, genome editing technologies may be used to alter or modify the introduced polynucleotide sequence. Site specific modifications that can be introduced into the disclosed IPD113 polynucleotide compositions include those produced using any method for introducing site specific modification, including, but not limited to, through the use of gene repair oligonucleotides (e.g. US Publication 2013/0019349), or through the use of double-stranded break technologies such as TALENs, meganucleases, zinc finger nucleases, CRISPR-Cas, and the like. Such technologies can be used to modify the previously introduced polynucleotide through the insertion, deletion or substitution of nucleotides within the introduced polynucleotide. Alternatively, double-stranded break technologies can be used to add additional nucleotide sequences to the introduced polynucleotide. Additional sequences that may be added include, additional expression elements, such as enhancer and promoter sequences. In another embodiment, genome editing technologies may be used to position additional insecticidally-active proteins in close proximity to the disclosed IPD113 polynucleotide compositions disclosed herein within the genome of a plant, to generate molecular stacks of insecticidally-active proteins.

An "altered target site," "altered target sequence." "modified target site," and "modified target sequence" are used interchangeably herein and refer to a target sequence as disclosed herein that comprises at least one alteration when compared to non-altered target sequence. Such "alterations" include, for example: (i) replacement of at least one nucleotide, (ii) a deletion of at least one nucleotide, (iii) an insertion of at least one nucleotide, or (iv) any combination of (i)-(iii).

Stacking of Traits in Transgenic Plant

Transgenic plants may comprise a stack of one or more insecticidal polynucleotides disclosed herein with one or more additional polynucleotides resulting in the production or suppression of multiple polypeptide sequences. Transgenic plants comprising stacks of polynucleotide sequences can be obtained by either or both of traditional breeding methods or through genetic engineering methods. These methods include, but are not limited to, breeding individual lines each comprising a polynucleotide of interest, transforming a transgenic plant comprising a gene disclosed herein with a subsequent gene and co-transformation of genes into a single plant cell. As used herein, the term "stacked" includes having the multiple traits present in the same plant (i.e., both traits are incorporated into the nuclear genome, one trait is incorporated into the nuclear genome and one trait is incorporated into the genome of a plastid or both traits are incorporated into the genome of a plastid). In one non-limiting example, "stacked traits" comprise a molecular stack where the sequences are physically adjacent to each other. A trait, as used herein, refers to the phenotype derived from a particular sequence or groups of sequences. Co-transformation of genes can be carried out using single transformation vectors comprising multiple genes or genes carried separately on multiple vectors. If the sequences are stacked by genetically transforming the plants, the polynucleotide sequences of interest can be combined at any time and in any order. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO 1999/25821, WO 1999/25854, WO 1999/25840, WO 1999/25855 and WO 1999/25853, all of which are herein incorporated by reference.

In some embodiments, the polynucleotides encoding the IPD113 polypeptide disclosed herein, alone or stacked with one or more additional insect resistance traits can be stacked with one or more additional input traits (e.g., herbicide resistance, fungal resistance, virus resistance, stress tolerance, disease resistance, male sterility, stalk strength, and the like) or output traits (e.g., increased yield, modified starches, improved oil profile, balanced amino acids, high lysine or methionine, increased digestibility, improved fiber quality, drought resistance, and the like). Thus, the polynucleotide embodiments can be used to provide a complete agronomic package of improved crop quality with the ability to flexibly and cost effectively control any number of agronomic pests.

Transgenes useful for stacking include but are not limited to:

1. Transgenes that Confer Resistance to Insects or Disease and that Encode:

(A) Plant disease resistance genes. Plant defenses are often activated by specific interaction between the product of a disease resistance gene (R) in the plant and the product of a corresponding avirulence (Avr) gene in the pathogen. A plant variety can be transformed with cloned resistance gene to engineer plants that are resistant to specific pathogen strains. See, for example, Jones, et al., (1994) *Science* 266:789 (cloning of the tomato Cf-9 gene for resistance to *Cladosporium fulvum*); Martin, et al., (1993) *Science* 262: 1432 (tomato Pto gene for resistance to *Pseudomonas syringae* pv. tomato encodes a protein kinase); Mindrinos, et al., (1994) *Cell* 78:1089 (*Arabidopsis* RSP2 gene for resistance to *Pseudomonas syringae*), McDowell and Woffenden, (2003) *Trends Biotechnol.* 21(4):178-83 and Toyoda, et al., (2002) *Transgenic Res.* 11(6):567-82. A plant resistant to a disease is one that is more resistant to a pathogen as compared to the wild type plant.

(B) Genes encoding a *Bacillus thuringiensis* protein, a derivative thereof or a synthetic polypeptide modeled thereon. See, for example, Geiser, et al., (1986) *Gene* 48:109, who disclose the cloning and nucleotide sequence of a Bt delta-endotoxin gene. Moreover, DNA molecules encoding delta-endotoxin genes can be purchased from American Type Culture Collection (Rockville, Md.), for example, under ATCC® Accession Numbers 40098, 67136, 31995 and 31998. Other non-limiting examples of *Bacillus thuringiensis* transgenes being genetically engineered are given in the following patents and patent applications and hereby are incorporated by reference for this purpose: U.S. Pat. Nos. 5,188,960; 5,689,052; 5,880,275; 5,986,177; 6,023,013, 6,060,594, 6,063,597, 6,077,824, 6,620,988, 6,642,030, 6,713,259, 6,893,826, 7,105,332; 7,179,965, 7,208,474; 7,227,056, 7,288,643, 7,323,556, 7,329,736, 7,449,552, 7,468,278, 7,510,878, 7,521,235, 7,544,862, 7,605,304, 7,696,412, 7,629,504, 7,705,216, 7,772,465, 7,790,846, 7,858,849 and WO 1991/14778; WO 1999/31248; WO 2001/12731; WO 1999/24581 and WO 1997/40162.

Genes encoding pesticidal proteins may also be stacked including, but not limited to: insecticidal proteins from *Pseudomonas* sp. such as PSEEN3174 (Monalysin; (2011) *PLoS Pathogens* 7:1-13); from *Pseudomonas protegens* strain CHA0 and Pf-5 (previously *fluorescens*) (Pechy-Tarr, (2008) *Environmental Microbiology* 10:2368-2386; GenBank Accession No. EU400157); from *Pseudomonas taiwanensis* (Liu, et al., (2010) *J. Agric. Food Chem.*, 58:12343-12349) and from *Pseudomonas pseudoalcaligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxicology Journal,* 3:101-118 and Morgan, et al., (2001) *Applied and Envir. Micro.* 67:2062-2069); U.S. Pat. Nos. 6,048,838, and 6,379,946; a PIP-1 polypeptide of U.S. Pat. No. 9,688,730; an AfIP-1A and/or AfIP-1B polypeptide of U.S. Pat. No. 9,475,847; a PIP-47 polypeptide of US Publication Number US20160186204; an IPD045 polypeptide, an IPD064 polypeptide, an IPD074 polypeptide, an IPD075 polypeptide, and an IPD077 polypeptide of PCT Publication Number WO 2016/114973; an IPD080 polypeptide of PCT Serial Number PCT/US17/56517; an IPD078 polypeptide, an IPD084 polypeptide, an IPD085 polypeptide, an IPD086 polypeptide, an IPD087 polypeptide, an IPD088 polypeptide, and an IPD089 polypeptide of Serial Number PCT/US17/54160; PIP-72 polypeptide of US Patent Publication Number US20160366891; a PtIP-50 polypeptide and a PtIP-65 polypeptide of US Publication Number US20170166921; an IPD098 polypeptide, an IPD059 polypeptide, an IPD108 polypeptide, an IPD109 polypeptide of U.S. Ser. No. 62/521,084; a PtIP-83 polypeptide of US Publication Number US20160347799; a PtIP-96 polypeptide of US Publication Number US20170233440; an IPD079 polypeptide of PCT Publication Number WO2017/23486; an IPD082 polypeptide of PCT Publication Number WO 2017/105987, an IPD090 polypeptide of Serial Number PCT/US17/30602, an IPD093 polypeptide of U.S. Ser. No. 62/434,020; an IPD103 polypeptide of Serial Number PCT/US17/39376; an IPD101 polypeptide of U.S. Ser. No. 62/438,179; an IPD121 polypeptide of US Serial Number U.S. 62/508,514; and δ-endotoxins including, but not limited to a Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry28, Cry29, Cry30, Cry31, Cry32, Cry33, Cry34, Cry35, Cry36, Cry37, Cry38, Cry39, Cry40, Cry41, Cry42, Cry43, Cry44, Cry45, Cry46, Cry47, Cry49, Cry50, Cry51, Cry52, Cry53, Cry54, Cry55, Cry56, Cry57, Cry58, Cry59, Cry60, Cry61, Cry62, Cry63, Cry64, Cry65, Cry66, Cry67, Cry68, Cry69, Cry70, Cry71, and Cry 72 classes of δ-endotoxin polypeptides and the *B. thuringiensis* cytolytic cyt1 and cyt2 genes. Members of these classes of *B. thuringiensis* insecticidal proteins (see, Crickmore, et al., "*Bacillus thuringiensis* toxin nomenclature" (2011), and can be found at lifesci.sussex.ac.uk/home/Neil_Crickmore/Bt/, which can be accessed on the world-wide web using the "www" prefix).

Examples of δ-endotoxins also include but are not limited to Cry1A proteins of U.S. Pat. Nos. 5,880,275, 7,858,849, and 8,878,007; a Cry1Ac mutant of U.S. Pat. No. 9,512,187; a DIG-3 or DIG-11 toxin (N-terminal deletion of α-helix 1 and/or α-helix 2 variants of cry proteins such as Cry1A, Cry3A) of U.S. Pat. Nos. 8,304,604, 8,304,605 and 8,476, 226; Cry1B of U.S. patent application Ser. No. 10/525,318, US Patent Application Publication Number US20160194364, and U.S. Pat. Nos. 9,404,121 and 8,772, 577; Cry1B variants of PCT Publication Number WO2016/61197 and Serial Number PCT/US17/27160; Cry1C of U.S. Pat. No. 6,033,874; Cry1D protein of US20170233759; a Cry1E protein of PCT Serial Number PCT/US17/53178; a Cry1F protein of U.S. Pat. Nos. 5,188,960 and 6,218,188; Cry1A/F chimeras of U.S. Pat. Nos. 7,070,982; 6,962,705 and 6,713,063; a Cry1I protein of PCT Publication number WO 2017/0233759; a Cry1J variant of US Publication US20170240603; a Cry2 protein such as Cry2Ab protein of U.S. Pat. No. 7,064,249 and Cry2A.127 protein of U.S. Pat. No. 7,208,474; a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,339,092, 7,378,499, 7,462,760, and 9,593,345; a Cry9 protein such as such as members of the Cry9A, Cry9B, Cry9C, Cry9D, Cry9E and Cry9F families including the Cry9 protein of U.S. Pat. Nos. 9,000,261 and 8,802,933, and US Serial Number WO 2017/132188; a Cry15 protein of Naimov, et al., (2008) Applied and Environmental Microbiology, 74:7145-7151; a Cry14 protein of U.S. Pat. No. 8,933,299; a Cry22, a Cry34Ab1 protein of U.S. Pat. Nos. 6,127,180, 6,624,145 and 6,340,593; a truncated Cry34 protein of U.S. Pat. No. 8,816,157; a CryET33 and cryET34 protein of U.S. Pat. Nos. 6,248,535, 6,326,351, 6,399,330, 6,949,626, 7,385,107 and 7,504,229; a CryET33 and CryET34 homologs of US Patent Publication Number 2006/0191034, 2012/0278954, and PCT Publication Number WO 2012/139004; a Cry35Ab1 protein of U.S. Pat. Nos. 6,083,499, 6,548,291 and 6,340,593; a Cry46 protein of U.S. Pat. No. 9,403,881, a Cry 51 protein, a Cry binary toxin; a TIC901 or related toxin; TIC807 of US Patent Application Publication Number 2008/0295207; TIC853 of U.S. Pat. No. 8,513,493; ET29, ET37, TIC809, TIC810, TIC812, TIC127, TIC128 of PCT US 2006/033867; engineered Hemipteran toxic proteins of US Patent Application Publication Number US20160150795, AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020 and AXMI-021 of WO 2006/083891; AXMI-010 of WO 2005/038032; AXMI-003 of WO 2005/021585; AXMI-008 of US Patent Application Publication Number 2004/0250311; AXMI-006 of US Patent Application Publication Number 2004/0216186; AXMI-007 of US Patent Application Publication Number 2004/0210965; AXMI-009 of US Patent Application Number 2004/0210964; AXMI-014 of US Patent Application Publication Number 2004/0197917; AXMI-004 of US Patent Application Publication Number 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US Patent Application Publication Number 2011/0023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063 and AXMI-064 of US Patent Application Publication Number 2011/0263488; AXMI046, AXMI048, AXMI050, AXMI051, AXMI052, AXMI053, AXMI054, AXMI055, AXMI056, AXMI057, AXMI058, AXMI059, AXMI060, AXMI061, AXMI067, AXMI069, AXMI071, AXMI072, AXMI073, AXMI074, AXMI075, AXMI087, AXMI088, AXMI093, AXMI070, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI125, AXMI126, AXMI127, AXMI129, AXMI151, AXMI161, AXMI164, AXMI183, AXMI132, AXMI137, AXMI138 of U.S. Pat. Nos. 8,461,421 and 8,461,422; AXMI-R1 and related proteins of US Patent Application Publication Number 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230 and AXMI231 of WO 2011/103247; AXMI-115, AXMI-113, AXMI-005, AXMI-163 and AXMI-184 of U.S. Pat. No. 8,334,431; AXMI-001, AXMI-002, AXMI-030, AXMI-035 and AXMI-045 of US Patent Application Publication Number 2010/0298211; AXMI-066 and AXMI-076 of US Patent Application Publication Number 2009/0144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, dsAXMI111, AXMI112, AXMI114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of U.S. Pat. No. 8,461,421; AXMI192 of U.S. Pat. No. 8,461,415; AXMI281 of US Patent Application Publication Number US20160177332; AXMI422 of U.S. Pat. No. 8,252,872; cry proteins such as Cry1A and Cry3A having modified proteolytic sites of U.S. Pat. No. 8,319,019; a Cry1Ac, Cry2Aa and Cry1Ca toxin protein from *Bacillus thuringiensis* strain VBTS 2528 of US Patent Application Publication Number 2011/0064710. The Cry proteins MP032, MP049, MP051, MP066, MP068, MP070, MP091S, MP109S, MP114, MP121, MP134S, MP183S, MP185S, MP186S, MP195S, MP197S, MP208S, MP209S, MP212S, MP214S, MP217S, MP222S, MP234S, MP235S, MP237S, MP242S, MP243, MP248, MP249S, MP251M, MP252S, MP253, MP259S, MP287S, MP288S, MP295S, MP296S, MP297S, MP300S, MP304S, MP306S, MP310S, MP312S, MP314S, MP319S, MP325S, MP326S, MP327S, MP328S, MP334S, MP337S, MP342S, MP349S, MP356S, MP359S, MP360S, MP437S, MP451S, MP452S, MP466S, MP468S, MP476S, MP482S, MP522S, MP529S, MP548S, MP552S, MP562S, MP564S, MP566S, MP567S, MP569S, MP573S, MP574S, MP575S, MP581S, MP590, MP594S, MP596S, MP597, MP599S, MP600S, MP601S, MP602S, MP604S, MP626S, MP629S, MP630S, MP631S, MP632S, MP633S, MP634S, MP635S, MP639S, MP640S, MP644S, MP649S, MP651S, MP652S, MP653S, MP661S, MP666S, MP672S, MP696S, MP704S, MP724S, MP729S, MP739S, MP755S, MP773S, MP799S, MP800S, MP801S, MP802S, MP803S, MP805S, MP809S, MP815S, MP828S, MP831S, MP844S, MP852, MP865S, MP879S, MP887S, MP891S, MP896S, MP898S, MP935S, MP968, MP989, MP993, MP997, MP1049, MP1066, MP1067, MP1080, MP1081, MP1200, MP1206, MP1233, and MP1311 of U.S. Ser. No. 62/607,372. The insecticidal activity of Cry proteins is well known to one skilled in the art (for review, see, van Frannkenhuyzen, (2009) J. Invert. Path. 101:1-16). The use of Cry proteins as transgenic plant traits is well known to one skilled in the art and Cry-transgenic plants including but not limited to plants expressing Cry1Ac, Cry1Ac+Cry2Ab, Cry1Ab, Cry1A.105, Cry1F, Cry1Fa2, Cry1F+Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) Plant Biotech Journal 9:283-300 and the CERA. (2010) GM Crop Database Center for Environmental Risk Assessment (CERA), ILSI Research Foundation, Washington D.C. at cera-gmc.org/index.php?action=gm_crop_database which can be accessed on the world-wide web using the "www" prefix). More than one pesticidal proteins can also be expressed in plants such as Vip3Ab & Cry1Fa (US2012/0317682); Cry1BE & Cry1F (US2012/0311746); Cry1CA & Cry1AB (US2012/0311745); Cry1F & CryCa (US2012/0317681); Cry1DA & Cry1BE (US2012/0331590); Cry1DA & Cry1Fa (US2012/0331589); Cry1AB & Cry1BE (US2012/0324606); Cry1Fa & Cry2Aa and Cry1I & Cry1E (US2012/0324605); Cry34Ab/35Ab & Cry6Aa (US20130167269); Cry34Ab/VCry35Ab & Cry3Aa (US20130167268); Cry1Da & Cry1Ca (U.S. Pat. No. 9,796, 982); Cry3Aa & Cry6Aa (U.S. Pat. No. 9,798,963); and Cry3A & Cry1Ab or Vip3Aa (U.S. Pat. No. 9,045,766). Pesticidal proteins also include insecticidal lipases including lipid acyl hydrolases of U.S. Pat. No. 7,491,869, and cholesterol oxidases such as from *Streptomyces* (Purcell et al. (1993) Biochem Biophys Res Commun 15:1406-1413). Pesticidal proteins also include VIP (vegetative insecticidal proteins) toxins of U.S. Pat. Nos. 5,877,012, 6,107,279 6,137,033, 7,244,820, 7,615,686, and 8,237,020 and the like. Other VIP proteins are well known (see, lifesci.sussex.ac.uk/home/Neil_Crickmore/Bt/vip.html which can be accessed on the world-wide web using the "www" prefix). Pesticidal proteins also include Cyt proteins including Cyt1A variants of PCT Serial Number PCT/US2017/000510; Pesticidal proteins also include toxin complex (TC) proteins, obtainable from organisms such as *Xenorhabdus, Photorhabdus* and *Paenibacillus* (see, U.S. Pat. Nos. 7,491, 698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but not limited to lycotoxin-1 peptides and mutants thereof (U.S. Pat. No. 8,334,366).

(C) A polynucleotide encoding an insect-specific hormone or pheromone such as an ecdysteroid and juvenile hormone, a variant thereof, a mimetic based thereon or an antagonist or agonist thereof. See, for example, the disclosure by Hammock, et al., (1990) *Nature* 344:458, of baculovirus expression of cloned juvenile hormone esterase, an inactivator of juvenile hormone.

(D) A polynucleotide encoding an insect-specific peptide which, upon expression, disrupts the physiology of the affected pest. For example, see the disclosures of, Regan, (1994) *J. Biol. Chem.* 269:9 (expression cloning yields DNA coding for insect diuretic hormone receptor); Pratt, et al., (1989) *Biochem. Biophys. Res. Comm.* 163:1243 (an allostatin is identified in *Diploptera puntata*); Chattopadhyay, et al., (2004) *Critical Reviews in Microbiology* 30(1):33-54; Zjawiony, (2004) *J Nat Prod* 67(2):300-310; Carlini and Grossi-de-Sa, (2002) *Toxicon* 40(11):1515-1539; Ussuf, et al., (2001) *Curr Sci.* 80(7):847-853 and Vasconcelos and Oliveira, (2004) *Toxicon* 44(4):385-403. See also, U.S. Pat. No. 5,266,317 to Tomalski, et al., who disclose genes encoding insect-specific toxins.

(E) A polynucleotide encoding an enzyme responsible for a hyperaccumulation of a monoterpene, a sesquiterpene, a steroid, hydroxamic acid, a phenylpropanoid derivative or another non-protein molecule with insecticidal activity.

(F) A polynucleotide encoding an enzyme involved in the modification, including the post-translational modification, of a biologically active molecule; for example, a glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic. See, PCT Application WO 1993/02197 in the name of Scott, et al., which discloses the nucleotide sequence of a callase gene. DNA molecules which contain chitinase-encoding sequences can be obtained, for example, from the ATCC® under Accession Numbers 39637 and 67152. See also, Kramer, et al., (1993) *Insect Biochem. Molec. Biol.* 23:691, who teach the nucleotide sequence of a cDNA encoding tobacco hookworm chitinase and Kawalleck, et al., (1993) *Plant Molec. Biol.* 21:673, who provide the nucleotide sequence of the parsley ubi4-2 polyubiquitin gene, and U.S. Pat. Nos. 6,563,020; 7,145,060 and 7,087, 810.

(G) A polynucleotide encoding a molecule that stimulates signal transduction. For example, see the disclosure by Botella, et al., (1994) *Plant Molec. Biol.* 24:757, of nucleotide sequences for mung bean calmodulin cDNA clones, and Griess, et al., (1994) *Plant Physiol.* 104:1467, who provide the nucleotide sequence of a maize calmodulin cDNA clone.

(H) A polynucleotide encoding a hydrophobic moment peptide. See, PCT Application WO 1995/16776 and U.S. Pat. No. 5,580,852 disclosure of peptide derivatives of Tachyplesin which inhibit fungal plant pathogens) and PCT Application WO 1995/18855 and U.S. Pat. No. 5,607,914 (teaches synthetic antimicrobial peptides that confer disease resistance).

(I) A polynucleotide encoding a membrane permease, a channel former or a channel blocker. For example, see the disclosure by Jaynes, et al., (1993) *Plant Sci.* 89:43, of heterologous expression of a cecropin-beta lytic peptide analog to render transgenic tobacco plants resistant to *Pseudomonas solanacearum*.

(J) A gene encoding a viral-invasive protein or a complex toxin derived therefrom. For example, the accumulation of viral coat proteins in transformed plant cells imparts resistance to viral infection and/or disease development effected by the virus from which the coat protein gene is derived, as well as by related viruses. See, Beachy, et al., (1990) *Ann. Rev. Phytopathol.* 28:451. Coat protein-mediated resistance has been conferred upon transformed plants against alfalfa mosaic virus, cucumber mosaic virus, tobacco streak virus, potato virus X, potato virus Y, tobacco etch virus, tobacco rattle virus and tobacco mosaic virus. Id.

(K) A gene encoding an insect-specific antibody or an immunotoxin derived therefrom. Thus, an antibody targeted to a critical metabolic function in the insect gut would inactivate an affected enzyme, killing the insect. Cf. Taylor, et al., Abstract #497, SEVENTH INT'L SYMPOSIUM ON MOLECULAR PLANT-MICROBE INTERACTIONS (Edinburgh, Scotland, 1994) (enzymatic inactivation in transgenic tobacco via production of single-chain antibody fragments).

(L) A gene encoding a virus-specific antibody. See, for example, Tavladoraki, et al., (1993) *Nature* 366:469, who show that transgenic plants expressing recombinant antibody genes are protected from virus attack.

(M) A polynucleotide encoding a developmental-arrestive protein produced in nature by a pathogen or a parasite. Thus, fungal endo alpha-1,4-D-polygalacturonases facilitate fungal colonization and plant nutrient release by solubilizing plant cell wall homo-alpha-1,4-D-galacturonase. See, Lamb, et al., (1992) *Bio/Technology* 10:1436. The cloning and characterization of a gene which encodes a bean endopolygalacturonase-inhibiting protein is described by Toubart, et al., (1992) *Plant J.* 2:367.

(N) A polynucleotide encoding a developmental-arrestive protein produced in nature by a plant. For example, Logemann, et al., (1992) *Bio/Technology* 10:305, have shown that transgenic plants expressing the barley ribosome-inactivating gene have an increased resistance to fungal disease.

(O) Genes involved in the Systemic Acquired Resistance (SAR) Response and/or the pathogenesis related genes. Briggs, (1995) *Current Biology* 5(2), Pieterse and Van Loon, (2004) *Curr. Opin. Plant Bio.* 7(4):456-64 and Somssich, (2003) *Cell* 113(7):815-6.

(P) Antifungal genes (Cornelissen and Melchers, (1993) *Pl. Physiol.* 101:709-712 and Parijs, et al., (1991) *Planta* 183:258-264 and Bushnell, et al., (1998) *Can. J. of Plant Path.* 20(2):137-149. Also see, U.S. patent application Ser. Nos. 09/950,933; 11/619,645; 11/657,710; 11/748,994; 11/774,121 and U.S. Pat. Nos. 6,891,085 and 7,306,946. LysM Receptor-like kinases for the perception of chitin fragments as a first step in plant defense response against fungal pathogens (US 2012/0110696).

(Q) Detoxification genes, such as for fumonisin, beauvericin, moniliformin and zearalenone and their structurally related derivatives. For example, see, U.S. Pat. Nos. 5,716, 820; 5,792,931; 5,798,255; 5,846,812; 6,083,736; 6,538, 177; 6,388,171 and 6,812,380.

(R) A polynucleotide encoding a Cystatin and cysteine proteinase inhibitors. See, U.S. Pat. No. 7,205,453.

(S) Defensin genes. See, WO 2003/000863 and U.S. Pat. Nos. 6,911,577; 6,855,865; 6,777,592 and 7,238,781.

(T) Genes conferring resistance to nematodes. See, e.g., PCT Application WO 1996/30517; PCT Application WO 1993/19181, WO 2003/033651 and Urwin, et al., (1998) *Planta* 204:472-479, Williamson, (1999) *Curr Opin Plant Bio.* 2(4):327-31; U.S. Pat. Nos. 6,284,948 and 7,301,069 and miR164 genes (WO 2012/058266).

(U) Genes that confer resistance to *Phytophthora* Root Rot, such as the Rps 1, Rps 1-a, Rps 1-b, Rps 1-c, Rps 1-d, Rps 1-e, Rps 1-k, Rps 2, Rps 3-a, Rps 3-b, Rps 3-c, Rps 4, Rps 5, Rps 6, Rps 7 and other Rps genes. See, for example, Shoemaker, et al., *Phytophthora* Root Rot Resistance Gene Mapping in Soybean, Plant Genome IV Conference, San Diego, Calif. (1995).

(V) Genes that confer resistance to Brown Stem Rot, such as described in U.S. Pat. No. 5,689,035 and incorporated by reference for this purpose.

(W) Genes that confer resistance to *Colletotrichum*, such as described in US Patent Application Publication US 2009/0035765 and incorporated by reference for this purpose. This includes the Rcg locus that may be utilized as a single locus conversion.

2. Transgenes that Confer Resistance to a Herbicide, for Example:

(A) A polynucleotide encoding resistance to a herbicide that inhibits the growing point or meristem, such as an imidazolinone or a sulfonylurea. Exemplary genes in this category code for mutant ALS and AHAS enzyme as described, for example, by Lee, et al., (1988) *EMBO J.* 7:1241 and Miki, et al., (1990) *Theor. Appl. Genet.* 80:449, respectively. See also, U.S. Pat. Nos. 5,605,011; 5,013,659; 5,141,870; 5,767,361; 5,731,180; 5,304,732; 4,761,373; 5,331,107; 5,928,937 and 5,378,824; U.S. patent application Ser. No. 11/683,737 and International Publication WO 1996/33270.

(B) A polynucleotide encoding a protein for resistance to Glyphosate (resistance imparted by mutant 5-enolpyruvl-3-phosphikimate synthase (EPSP) and aroA genes, respectively) and other phosphono compounds such as glufosinate (phosphinothricin acetyl transferase (PAT) and *Streptomyces hygroscopicus* phosphinothricin acetyl transferase (bar) genes), and pyridinoxy or phenoxy proprionic acids and cyclohexones (ACCase inhibitor-encoding genes). See, for example, U.S. Pat. No. 4,940,835 to Shah, et al., which discloses the nucleotide sequence of a form of EPSPS which can confer glyphosate resistance. U.S. Pat. No. 5,627,061 to Barry, et al., also describes genes encoding EPSPS enzymes. See also, U.S. Pat. Nos. 6,566,587; 6,338,961; 6,248,876; 6,040,497; 5,804,425; 5,633,435; 5,145,783; 4,971,908; 5,312,910; 5,188,642; 5,094,945; 4,940,835; 5,866,775; 6,225,114; 6,130,366; 5,310,667; 4,535,060; 4,769,061; 5,633,448; 5,510,471; Re. 36,449; RE 37,287 E and 5,491, 288 and International Publications EP 1173580; WO 2001/66704; EP 1173581 and EP 1173582, which are incorporated herein by reference for this purpose. Glyphosate resistance is also imparted to plants that express a gene encoding a glyphosate oxido-reductase enzyme as described more fully in U.S. Pat. Nos. 5,776,760 and 5,463,175, which are incorporated herein by reference for this purpose. In addition glyphosate resistance can be imparted to plants by the over expression of genes encoding glyphosate N-acetyltransferase. See, for example, U.S. Pat. Nos. 7,462,481; 7,405,074 and US Patent Application Publication Number US 2008/0234130. A DNA molecule encoding a mutant aroA gene can be obtained under ATCC® Accession Number 39256, and the nucleotide sequence of the mutant gene is disclosed in U.S. Pat. No. 4,769,061 to Comai. EP Application Number 0 333 033 to Kumada, et al., and U.S. Pat. No. 4,975,374 to Goodman, et al., disclose nucleotide sequences of glutamine synthetase genes which confer resistance to herbicides such as L-phosphinothricin. The nucleotide sequence of a phosphinothricin-acetyltransferase gene is provided in EP Application Numbers 0 242 246 and 0 242 236 to Leemans, et al.; De Greef, et al., (1989) *Bio/Technology* 7:61, describe the production of transgenic plants that express chimeric bar genes coding for phosphinothricin acetyl transferase activity. See also, U.S. Pat. Nos. 5,969,213; 5,489,520; 5,550, 318; 5,874,265; 5,919,675; 5,561,236; 5,648,477; 5,646, 024; 6,177,616 and 5,879,903, which are incorporated herein by reference for this purpose. Exemplary genes conferring resistance to phenoxy proprionic acids and cyclohexones, such as sethoxydim and haloxyfop, are the Acc1-S1, Acc1-52 and Acc1-S3 genes described by Marshall, et al., (1992) *Theor. Appl. Genet.* 83:435.

(C) A polynucleotide encoding a protein for resistance to herbicide that inhibits photosynthesis, such as a triazine (psbA and gs+genes) and a benzonitrile (nitrilase gene). Przibilla, et al., (1991) *Plant Cell* 3:169, describe the transformation of *Chlamydomonas* with plasmids encoding mutant psbA genes. Nucleotide sequences for nitrilase genes are disclosed in U.S. Pat. No. 4,810,648 to Stalker and DNA molecules containing these genes are available under ATCC® Accession Numbers 53435, 67441 and 67442. Cloning and expression of DNA coding for a glutathione S-transferase is described by Hayes, et al., (1992) *Biochem. J.* 285:173.

(D) A polynucleotide encoding a protein for resistance to Acetohydroxy acid synthase, which has been found to make plants that express this enzyme resistant to multiple types of herbicides, has been introduced into a variety of plants (see, e.g., Hattori, et al., (1995) *Mol Gen Genet.* 246:419). Other genes that confer resistance to herbicides include: a gene encoding a chimeric protein of rat cytochrome P4507A1 and yeast NADPH-cytochrome P450 oxidoreductase (Shiota, et al., (1994) *Plant Physiol* 106:17), genes for glutathione reductase and superoxide dismutase (Aono, et al., (1995) *Plant Cell Physiol* 36:1687) and genes for various phosphotransferases (Datta, et al., (1992) *Plant Mol Biol* 20:619).

(E) A polynucleotide encoding resistance to a herbicide targeting Protoporphyrinogen oxidase (protox) which is necessary for the production of chlorophyll. The protox enzyme serves as the target for a variety of herbicidal compounds. These herbicides also inhibit growth of all the different species of plants present, causing their total destruction. The development of plants containing altered protox activity which are resistant to these herbicides are described in U.S. Pat. Nos. 6,288,306; 6,282,83 and 5,767,373 and International Publication WO 2001/12825.

(F) The aad-1 gene (originally from *Sphingobium herbicidovorans*) encodes the aryloxyalkanoate dioxygenase (AAD-1) protein. The trait confers tolerance to 2,4-dichlorophenoxyacetic acid and aryloxyphenoxypropionate (commonly referred to as "fop" herbicides such as quizalofop) herbicides. The aad-1 gene, itself, for herbicide tolerance in plants was first disclosed in WO 2005/107437 (see also, US 2009/0093366). The aad-12 gene, derived from *Delftia acidovorans*, which encodes the aryloxyalkanoate dioxygenase (AAD-12) protein that confers tolerance to 2,4-dichlorophenoxyacetic acid and pyridyloxyacetate herbicides by deactivating several herbicides with an aryloxyalkanoate moiety, including phenoxy auxin (e.g., 2,4-D, MCPA), as well as pyridyloxy auxins (e.g., fluroxypyr, triclopyr).

(G) A polynucleotide encoding a herbicide resistant dicamba monooxygenase disclosed in US Patent Application Publication 2003/0135879 for imparting dicamba tolerance;

(H) A polynucleotide molecule encoding bromoxynil nitrilase (Bxn) disclosed in U.S. Pat. No. 4,810,648 for imparting bromoxynil tolerance;

(I) A polynucleotide molecule encoding phytoene (crtI) described in Misawa, et al., (1993) *Plant J.* 4:833-840 and in Misawa, et al., (1994) *Plant J.* 6:481-489 for norflurazon tolerance.

3. Transgenes that Confer or Contribute to an Altered Grain Characteristic

Such as:

(A) Altered fatty acids, for example, by (1) Down-regulation of stearoyl-ACP to increase stearic acid content of the plant. See, Knultzon, et al., (1992) *Proc. Natl. Acad. Sci. USA* 89:2624 and WO 1999/64579 (Genes to Alter Lipid Profiles in Corn).

(2) Elevating oleic acid via FAD-2 gene modification and/or decreasing linolenic acid via FAD-3 gene modification (see, U.S. Pat. Nos. 6,063,947; 6,323,392; 6,372,965 and WO 1993/11245).

(3) Altering conjugated linolenic or linoleic acid content, such as in WO 2001/12800.

(4) Altering LEC1, AGP, Dek1, Superal1, mi1 ps, and various Ipa genes such as Ipa1, Ipa3, hpt or hggt. For example, see, WO 2002/42424, WO 1998/22604, WO 2003/011015, WO 2002/057439, WO 2003/011015, U.S. Pat. Nos. 6,423,886, 6,197,561, 6,825,397 and US Patent Application Publication Numbers US 2003/0079247, US 2003/0204870 and Rivera-Madrid, et al., (1995) *Proc. Natl. Acad. Sci.* 92:5620-5624.

(5) Genes encoding delta-8 desaturase for making long-chain polyunsaturated fatty acids (U.S. Pat. Nos. 8,058,571 and 8,338,152), delta-9 desaturase for lowering saturated fats (U.S. Pat. No. 8,063,269), *Primula* 46-desaturase for improving omega-3 fatty acid profiles.

(6) Isolated nucleic acids and proteins associated with lipid and sugar metabolism regulation, in particular, lipid metabolism protein (LMP) used in methods of producing transgenic plants and modulating levels of seed storage compounds including lipids, fatty acids, starches or seed storage proteins and use in methods of modulating the seed size, seed number, seed weights, root length and leaf size of plants (EP 2404499).

(7) Altering expression of a High-Level Expression of Sugar-Inducible 2 (HSI2) protein in the plant to increase or decrease expression of HSI2 in the plant. Increasing expression of HSI2 increases oil content while decreasing expression of HSI2 decreases abscisic acid sensitivity and/or increases drought resistance (US Patent Application Publication Number 2012/0066794).

(8) Expression of cytochrome b5 (Cb5) alone or with FAD2 to modulate oil content in plant seed, particularly to increase the levels of omega-3 fatty acids and improve the ratio of omega-6 to omega-3 fatty acids (US Patent Application Publication Number 2011/0191904).

(9) Nucleic acid molecules encoding wrinkled1-like polypeptides for modulating sugar metabolism (U.S. Pat. No. 8,217,223).

(B) Altered phosphorus content, for example, by the (1) Introduction of a phytase-encoding gene would enhance breakdown of phytate, adding more free phosphate to the transformed plant. For example, see, Van Hartingsveldt, et al., (1993) *Gene* 127:87, for a disclosure of the nucleotide sequence of an *Aspergillus niger* phytase gene.

(2) Modulating a gene that reduces phytate content. In maize, this, for example, could be accomplished, by cloning and then re-introducing DNA associated with one or more of the alleles, such as the LPA alleles, identified in maize mutants characterized by low levels of phytic acid, such as in WO 2005/113778 and/or by altering inositol kinase activity as in WO 2002/059324, US Patent Application Publication Number 2003/0009011, WO 2003/027243, US Patent Application Publication Number 2003/0079247, WO 1999/05298, U.S. Pat. Nos. 6,197,561, 6,291,224, 6,391,348, WO 2002/059324, US Patent Application Publication Number 2003/0079247, WO 1998/45448, WO 1999/55882, WO 2001/04147.

(C) Altered carbohydrates affected, for example, by altering a gene for an enzyme that affects the branching pattern of starch or, a gene altering thioredoxin such as NTR and/or TRX (see, U.S. Pat. No. 6,531,648. which is incorporated by reference for this purpose) and/or a gamma zein knock out or mutant such as cs27 or TUSC27 or en27 (see, U.S. Pat. No. 6,858,778 and US Patent Application Publication Number 2005/0160488, US Patent Application Publication Number 2005/0204418, which are incorporated by reference for this purpose). See, Shiroza, et al., (1988) *J. Bacteriol.*

170:810 (nucleotide sequence of *Streptococcus* mutant fructosyltransferase gene), Steinmetz, et al., (1985) *Mol. Gen. Genet.* 200:220 (nucleotide sequence of *Bacillus subtilis* levansucrase gene), Pen, et al., (1992) *Bio/Technology* 10:292 (production of transgenic plants that express *Bacillus licheniformis* alpha-amylase), Elliot, et al., (1993) *Plant Molec. Biol.* 21:515 (nucleotide sequences of tomato invertase genes), Søgaard, et al., (1993) *J. Biol. Chem.* 268:22480 (site-directed mutagenesis of barley alpha-amylase gene) and Fisher, et al., (1993) *Plant Physiol.* 102:1045 (maize endosperm starch branching enzyme II), WO 1999/10498 (improved digestibility and/or starch extraction through modification of UDP-D-xylose 4-epimerase, Fragile 1 and 2, Ref1, HCHL, C4H), U.S. Pat. No. 6,232,529 (method of producing high oil seed by modification of starch levels (AGP)). The fatty acid modification genes mentioned herein may also be used to affect starch content and/or composition through the interrelationship of the starch and oil pathways.

(D) Altered antioxidant content or composition, such as alteration of tocopherol or tocotrienols. For example, see, U.S. Pat. No. 6,787,683, US Patent Application Publication Number 2004/0034886 and WO 2000/68393 involving the manipulation of antioxidant levels and WO 2003/082899 through alteration of a homogentisate geranyl geranyl transferase (hggt).

(E) Altered essential seed amino acids. For example, see, U.S. Pat. No. 6,127,600 (method of increasing accumulation of essential amino acids in seeds), U.S. Pat. No. 6,080,913 (binary methods of increasing accumulation of essential amino acids in seeds), U.S. Pat. No. 5,990,389 (high lysine), WO 1999/40209 (alteration of amino acid compositions in seeds), WO 1999/29882 (methods for altering amino acid content of proteins), U.S. Pat. No. 5,850,016 (alteration of amino acid compositions in seeds), WO 1998/20133 (proteins with enhanced levels of essential amino acids), U.S. Pat. No. 5,885,802 (high methionine), U.S. Pat. No. 5,885,801 (high threonine), U.S. Pat. No. 6,664,445 (plant amino acid biosynthetic enzymes), U.S. Pat. No. 6,459,019 (increased lysine and threonine), U.S. Pat. No. 6,441,274 (plant tryptophan synthase beta subunit), U.S. Pat. No. 6,346,403 (methionine metabolic enzymes), U.S. Pat. No. 5,939,599 (high sulfur), U.S. Pat. No. 5,912,414 (increased methionine), WO 1998/56935 (plant amino acid biosynthetic enzymes), WO 1998/45458 (engineered seed protein having higher percentage of essential amino acids), WO 1998/42831 (increased lysine), U.S. Pat. No. 5,633,436 (increasing sulfur amino acid content), U.S. Pat. No. 5,559,223 (synthetic storage proteins with defined structure containing programmable levels of essential amino acids for improvement of the nutritional value of plants), WO 1996/01905 (increased threonine), WO 1995/15392 (increased lysine), US Patent Application Publication Number 2003/0163838, US Patent Application Publication Number 2003/0150014, US Patent Application Publication Number 2004/0068767, U.S. Pat. No. 6,803,498, WO 2001/79516.

4. Genes that Control Male-Sterility:

There are several methods of conferring genetic male sterility available, such as multiple mutant genes at separate locations within the genome that confer male sterility, as disclosed in U.S. Pat. Nos. 4,654,465 and 4,727,219 to Brar, et al., and chromosomal translocations as described by Patterson in U.S. Pat. Nos. 3,861,709 and 3,710,511. In addition to these methods, Albertsen, et al., U.S. Pat. No. 5,432,068, describe a system of nuclear male sterility which includes: identifying a gene which is critical to male fertility; silencing this native gene which is critical to male fertility; removing the native promoter from the essential male fertility gene and replacing it with an inducible promoter; inserting this genetically engineered gene back into the plant; and thus creating a plant that is male sterile because the inducible promoter is not "on" resulting in the male fertility gene not being transcribed. Fertility is restored by inducing or turning "on", the promoter, which in turn allows the gene that, confers male fertility to be transcribed.

(A) Introduction of a deacetylase gene under the control of a tapetum-specific promoter and with the application of the chemical N-Ac-PPT (WO 2001/29237).

(B) Introduction of various stamen-specific promoters (WO 1992/13956, WO 1992/13957).

(C) Introduction of the barnase and the barstar gene (Paul, et al., (1992) *Plant Mol. Biol.* 19:611-622).

For additional examples of nuclear male and female sterility systems and genes, see also, U.S. Pat. Nos. 5,859, 341; 6,297,426; 5,478,369; 5,824,524; 5,850,014 and 6,265, 640, all of which are hereby incorporated by reference.

5. Genes that Create a Site for Site Specific DNA Integration.

This includes the introduction of FRT sites that may be used in the FLP/FRT system and/or Lox sites that may be used in the Cre/Loxp system. For example, see, Lyznik, et al., (2003) *Plant Cell Rep* 21:925-932 and WO 1999/25821, which are hereby incorporated by reference. Other systems that may be used include the Gin recombinase of phage Mu (Maeser, et al., (1991) Vicki Chandler, *The Maize Handbook* ch. 118 (Springer-Verlag 1994), the Pin recombinase of *E. coli* (Enomoto, et al., 1983) and the R/RS system of the pSRi plasmid (Araki, et al., 1992).

6. Genes that Affect Abiotic Stress Resistance

Including but not limited to flowering, ear and seed development, enhancement of nitrogen utilization efficiency, altered nitrogen responsiveness, drought resistance or tolerance, cold resistance or tolerance and salt resistance or tolerance and increased yield under stress.

(A) For example, see: WO 2000/73475 where water use efficiency is altered through alteration of malate; U.S. Pat. Nos. 5,892,009, 5,965,705, 5,929,305, 5,891,859, 6,417, 428, 6,664,446, 6,706,866, 6,717,034, 6,801,104, WO 2000/060089, WO 2001/026459, WO 2001/035725, WO 2001/034726, WO 2001/035727, WO 2001/036444, WO 2001/036597, WO 2001/036598, WO 2002/015675, WO 2002/017430, WO 2002/077185, WO 2002/079403, WO 2003/013227, WO 2003/013228, WO 2003/014327, WO 2004/031349, WO 2004/076638, WO 199809521.

(B) WO 199938977 describing genes, including CBF genes and transcription factors effective in mitigating the negative effects of freezing, high salinity and drought on plants, as well as conferring other positive effects on plant phenotype.

(C) US Patent Application Publication Number 2004/0148654 and WO 2001/36596 where abscisic acid is altered in plants resulting in improved plant phenotype such as increased yield and/or increased tolerance to abiotic stress.

(D) WO 2000/006341, WO 2004/090143, U.S. Pat. Nos. 7,531,723 and 6,992,237 where cytokinin expression is modified resulting in plants with increased stress tolerance, such as drought tolerance, and/or increased yield. Also see, WO 2002/02776, WO 2003/052063, JP 2002/281975, U.S. Pat. No. 6,084,153, WO 2001/64898, U.S. Pat. Nos. 6,177, 275 and 6,107,547 (enhancement of nitrogen utilization and altered nitrogen responsiveness).

(E) For ethylene alteration, see, US Patent Application Publication Number 2004/0128719, US Patent Application Publication Number 2003/0166197 and WO 2000/32761.

(F) For plant transcription factors or transcriptional regulators of abiotic stress, see, e.g., US Patent Application Publication Number 2004/0098764 or US Patent Application Publication Number 2004/0078852.

(G) Genes that increase expression of vacuolar pyrophosphatase such as AVP1 (U.S. Pat. No. 8,058,515) for increased yield; nucleic acid encoding a HSFA4 or a HSFA5 (Heat Shock Factor of the class A4 or A5) polypeptides, an oligopeptide transporter protein (OPT4-like) polypeptide; a plastochron2-like (PLA2-like) polypeptide or a Wuschel related homeobox 1-like (WOX1-like) polypeptide (U. Patent Application Publication Number US 2011/0283420).

(H) Down regulation of polynucleotides encoding poly (ADP-ribose) polymerase (PARP) proteins to modulate programmed cell death (U.S. Pat. No. 8,058,510) for increased vigor.

(I) Polynucleotide encoding DTP21 polypeptides for conferring drought resistance (US Patent Application Publication Number US 2011/0277181).

(J) Nucleotide sequences encoding ACC Synthase 3 (ACS3) proteins for modulating development, modulating response to stress, and modulating stress tolerance (US Patent Application Publication Number US 2010/0287669).

(K) Polynucleotides that encode proteins that confer a drought tolerance phenotype (DTP) for conferring drought resistance (WO 2012/058528).

(L) Tocopherol cyclase (TC) genes for conferring drought and salt tolerance (US Patent Application Publication Number 2012/0272352).

(M) CAAX amino terminal family proteins for stress tolerance (U.S. Pat. No. 8,338,661).

(N) Mutations in the SAL1 encoding gene have increased stress tolerance, including increased drought resistant (US Patent Application Publication Number 2010/0257633).

(O) Expression of a nucleic acid sequence encoding a polypeptide selected from the group consisting of: GRF polypeptide, RAA1-like polypeptide, SYR polypeptide, ARKL polypeptide, and YTP polypeptide increasing yield-related traits (US Patent Application Publication Number 2011/0061133).

(P) Modulating expression in a plant of a nucleic acid encoding a Class III Trehalose Phosphate Phosphatase (TPP) polypeptide for enhancing yield-related traits in plants, particularly increasing seed yield (US Patent Application Publication Number 2010/0024067).

Other genes and transcription factors that affect plant growth and agronomic traits such as yield, flowering, plant growth and/or plant structure, can be introduced or introgressed into plants, see e.g., WO 1997/49811 (LHY), WO 1998/56918 (ESD4), WO 1997/10339 and U.S. Pat. No. 6,573,430 (TFL), U.S. Pat. No. 6,713,663 (FT), WO 1996/14414 (CON), WO 1996/38560, WO 2001/21822 (VRN1), WO 2000/44918 (VRN2), WO 1999/49064 (GI), WO 2000/46358 (FR1), WO 1997/29123, U.S. Pat. Nos. 6,794,560, 6,307,126 (GAI), WO 1999/09174 (D8 and Rht) and WO 2004/076638 and WO 2004/031349 (transcription factors).

7. Genes that Confer Increased Yield (A) A transgenic crop plant transformed by a 1-Amino-Cyclopropane-1-Carboxylate Deaminase-like Polypeptide (ACCDP) coding nucleic acid, wherein expression of the nucleic acid sequence in the crop plant results in the plant's increased root growth, and/or increased yield, and/or increased tolerance to environmental stress as compared to a wild type variety of the plant (U.S. Pat. No. 8,097,769).

(B) Over-expression of maize zinc finger protein gene (Zm-ZFP1) using a seed preferred promoter has been shown to enhance plant growth, increase kernel number and total kernel weight per plant (US Patent Application Publication Number 2012/0079623).

(C) Constitutive over-expression of maize lateral organ boundaries (LOB) domain protein (Zm-LOBDP1) has been shown to increase kernel number and total kernel weight per plant (US Patent Application Publication Number 2012/0079622).

(D) Enhancing yield-related traits in plants by modulating expression in a plant of a nucleic acid encoding a VIM1 (Variant in Methylation 1)-like polypeptide or a VTC2-like (GDP-L-galactose phosphorylase) polypeptide or a DUF1685 polypeptide or an ARF6-like (Auxin Responsive Factor) polypeptide (WO 2012/038893).

(E) Modulating expression in a plant of a nucleic acid encoding a Ste20-like polypeptide or a homologue thereof gives plants having increased yield relative to control plants (EP 2431472).

(F) Genes encoding nucleoside diphosphatase kinase (NDK) polypeptides and homologs thereof for modifying the plant's root architecture (US Patent Application Publication Number 2009/0064373).

8. Genes that Confer Plant Digestibility.

(A) Altering the level of xylan present in the cell wall of a plant by modulating expression of xylan synthase (U.S. Pat. No. 8,173,866).

In some embodiments, the stacked trait may be a trait or event that has received regulatory approval including but not limited to the events with regulatory and can be found at the Center for Environmental Risk Assessment (cera-gmc.org/?action=gm_crop_database, which can be accessed using the www prefix) and at the International Service for the Acquisition of Agri-Biotech Applications (isaaa.org/gmapprovaldatabase/default.asp, which can be accessed using the www prefix).

Gene Silencing

In some embodiments, the stacked trait may be in the form of silencing of one or more polynucleotides of interest resulting in suppression of one or more target pest polypeptides. In some embodiments, the silencing is achieved using a suppression DNA construct.

In some embodiments, one or more polynucleotide encoding the polypeptides of the IPD113 polypeptide or fragments or variants thereof may be stacked with one or more polynucleotides encoding one or more polypeptides having insecticidal activity or agronomic traits as set forth supra and optionally may further include one or more polynucleotides providing for gene silencing of one or more target polynucleotides as discussed infra.

"Suppression DNA construct" is a recombinant DNA construct which when transformed or stably integrated into the genome of the plant, results in "silencing" of a target gene in the plant. The target gene may be endogenous or transgenic to the plant. "Silencing," as used herein with respect to the target gene, refers generally to the suppression of levels of mRNA or protein/enzyme expressed by the target gene, and/or the level of the enzyme activity or protein functionality. The term "suppression" includes lower, reduce, decline, decrease, inhibit, eliminate and prevent. "Silencing" or "gene silencing" does not specify mechanism and is inclusive, and not limited to, anti-sense, cosuppression, viral-suppression, hairpin suppression, stem-loop suppression, RNAi-based approaches and small RNA-based approaches.

A suppression DNA construct may comprise a region derived from a target gene of interest and may comprise all or part of the nucleic acid sequence of the sense strand (or antisense strand) of the target gene of interest. Depending upon the approach to be utilized, the region may be 100% identical or less than 100% identical (e.g., at least 50% or any integer between 51% and 100% identical) to all or part of the sense strand (or antisense strand) of the gene of interest.

Suppression DNA constructs are readily constructed once the target gene of interest is selected, and include, without limitation, cosuppression constructs, antisense constructs, viral-suppression constructs, hairpin suppression constructs, stem-loop suppression constructs, double-stranded RNA-producing constructs, and more generally, RNAi (RNA interference) constructs and small RNA constructs such as siRNA (short interfering RNA) constructs and miRNA (microRNA) constructs.

"Antisense inhibition" refers to the production of antisense RNA transcripts capable of suppressing the expression of the target protein.

"Antisense RNA" refers to an RNA transcript that is complementary to all or part of a target primary transcript or mRNA and that blocks the expression of a target isolated nucleic acid fragment. The complementarity of an antisense RNA may be with any part of the specific gene transcript, i.e., at the 5' non-coding sequence, 3' non-coding sequence, introns or the coding sequence.

"Cosuppression" refers to the production of sense RNA transcripts capable of suppressing the expression of the target protein. "Sense" RNA refers to RNA transcript that includes the mRNA and can be translated into protein within a cell or in vitro. Cosuppression constructs in plants have been previously designed by focusing on overexpression of a nucleic acid sequence having homology to a native mRNA, in the sense orientation, which results in the reduction of all RNA having homology to the overexpressed sequence (see, Vaucheret, et al., (1998) *Plant J.* 16:651-659 and Gura, (2000) *Nature* 404:804-808).

Another variation describes the use of plant viral sequences to direct the suppression of proximal mRNA encoding sequences (PCT Publication WO 1998/36083).

Recent work has described the use of "hairpin" structures that incorporate all or part, of an mRNA encoding sequence in a complementary orientation that results in a potential "stem-loop" structure for the expressed RNA (PCT Publication WO 1999/53050). In this case the stem is formed by polynucleotides corresponding to the gene of interest inserted in either sense or anti-sense orientation with respect to the promoter and the loop is formed by some polynucleotides of the gene of interest, which do not have a complement in the construct. This increases the frequency of cosuppression or silencing in the recovered transgenic plants. For review of hairpin suppression, see, Wesley, et al., (2003) Methods in Molecular Biology, Plant Functional Genomics: Methods and Protocols 236:273-286.

A construct where the stem is formed by at least 30 nucleotides from a gene to be suppressed and the loop is formed by a random nucleotide sequence has also effectively been used for suppression (PCT Publication WO 1999/61632).

The use of poly-T and poly-A sequences to generate the stem in the stem-loop structure has also been described (PCT Publication WO 2002/00894).

Yet another variation includes using synthetic repeats to promote formation of a stem in the stem-loop structure. Transgenic organisms prepared with such recombinant DNA fragments have been shown to have reduced levels of the protein encoded by the nucleotide fragment forming the loop as described in PCT Publication WO 2002/00904.

RNA interference refers to the process of sequence-specific post-transcriptional gene silencing in animals mediated by short interfering RNAs (siRNAs) (Fire, et al., (1998) *Nature* 391:806). The corresponding process in plants is commonly referred to as post-transcriptional gene silencing (PTGS) or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire, et al., (1999) *Trends Genet.* 15:358). Such protection from foreign gene expression may have evolved in response to the production of double-stranded RNAs (dsRNAs) derived from viral infection or from the random integration of transposon elements into a host genome via a cellular response that specifically destroys homologous single-stranded RNA of viral genomic RNA. The presence of dsRNA in cells triggers the RNAi response through a mechanism that has yet to be fully characterized.

The presence of long dsRNAs in cells stimulates the activity of a ribonuclease Ill enzyme referred to as dicer. Dicer is involved in the processing of the dsRNA into short pieces of dsRNA known as short interfering RNAs (siRNAs) (Berstein, et al., (2001) *Nature* 409:363). Short interfering RNAs derived from dicer activity are typically about 21 to about 23 nucleotides in length and comprise about 19 base pair duplexes (Elbashir, et al., (2001) *Genes Dev.* 15:188). Dicer has also been implicated in the excision of 21- and 22-nucleotide small temporal RNAs (stRNAs) from precursor RNA of conserved structure that are implicated in translational control (Hutvagner, et al., (2001) *Science* 293:834). The RNAi response also features an endonuclease complex, commonly referred to as an RNA-induced silencing complex (RISC), which mediates cleavage of single-stranded RNA having sequence complementarity to the antisense strand of the siRNA duplex. Cleavage of the target RNA takes place in the middle of the region complementary to the antisense strand of the siRNA duplex (Elbashir, et al., (2001) *Genes Dev.* 15:188). In addition, RNA interference can also involve small RNA (e.g., miRNA) mediated gene silencing, presumably through cellular mechanisms that regulate chromatin structure and thereby prevent transcription of target gene sequences (see, e.g., Allshire, (2002) *Science* 297:1818-1819; Volpe, et al., (2002) *Science* 297: 1833-1837; Jenuwein, (2002) *Science* 297:2215-2218 and Hall, et al., (2002) *Science* 297:2232-2237). As such, miRNA molecules of the disclosure can be used to mediate gene silencing via interaction with RNA transcripts or alternately by interaction with particular gene sequences, wherein such interaction results in gene silencing either at the transcriptional or post-transcriptional level.

Methods and compositions are further provided which allow for an increase in RNAi produced from the silencing element. In such embodiments, the methods and compositions employ a first polynucleotide comprising a silencing element for a target pest sequence operably linked to a promoter active in the plant cell; and, a second polynucleotide comprising a suppressor enhancer element comprising the target pest sequence or an active variant or fragment thereof operably linked to a promoter active in the plant cell. The combined expression of the silencing element with suppressor enhancer element leads to an increased amplification of the inhibitory RNA produced from the silencing element over that achievable with only the expression of the silencing element alone. In addition to the increased amplification of the specific RNAi species itself, the methods and compositions further allow for the production of a diverse population of RNAi species that can enhance the effectiveness of disrupting target gene expression. As such, when the suppressor enhancer element is expressed in a plant cell in combination with the silencing element, the methods and composition can allow for the systemic production of RNAi throughout the plant; the production of greater amounts of RNAi than would be observed with just the silencing element construct alone; and, the improved loading of RNAi into the phloem of the plant, thus providing better control of phloem feeding insects by an RNAi approach. Thus, the various methods and compositions provide improved methods for the delivery of inhibitory RNA to the target organism. See, for example, US Patent Application Publication 2009/0188008.

As used herein, a "suppressor enhancer element" comprises a polynucleotide comprising the target sequence to be suppressed or an active fragment or variant thereof. It is recognized that the suppressor enhancer element need not be identical to the target sequence, but rather, the suppressor enhancer element can comprise a variant of the target sequence, so long as the suppressor enhancer element has sufficient sequence identity to the target sequence to allow for an increased level of the RNAi produced by the silencing element over that achievable with only the expression of the silencing element. Similarly, the suppressor enhancer element can comprise a fragment of the target sequence, wherein the fragment is of sufficient length to allow for an increased level of the RNAi produced by the silencing element over that achievable with only the expression of the silencing element.

It is recognized that multiple suppressor enhancer elements from the same target sequence or from different target sequences or from different regions of the same target sequence can be employed. For example, the suppressor enhancer elements employed can comprise fragments of the target sequence derived from different region of the target sequence (i.e., from the 3'UTR, coding sequence, intron, and/or 5'UTR). Further, the suppressor enhancer element can be contained in an expression cassette, as described elsewhere herein, and in specific embodiments, the suppressor enhancer element is on the same or on a different DNA vector or construct as the silencing element. The suppressor enhancer element can be operably linked to a promoter as disclosed herein. It is recognized that the suppressor enhancer element can be expressed constitutively or alternatively, it may be produced in a stage-specific manner employing the various inducible or tissue-preferred or developmentally regulated promoters that are discussed elsewhere herein.

In specific embodiments, employing both a silencing element and the suppressor enhancer element the systemic production of RNAi occurs throughout the entire plant. In further embodiments, the plant or plant parts of the disclosure have an improved loading of RNAi into the phloem of the plant than would be observed with the expression of the silencing element construct alone and, thus provide better control of phloem feeding insects by an RNAi approach. In specific embodiments, the plants, plant parts and plant cells of the disclosure can further be characterized as allowing for the production of a diversity of RNAi species that can enhance the effectiveness of disrupting target gene expression.

In specific embodiments, the combined expression of the silencing element and the suppressor enhancer element increases the concentration of the inhibitory RNA in the plant cell, plant, plant part, plant tissue or phloem over the level that is achieved when the silencing element is expressed alone.

As used herein, an "increased level of inhibitory RNA" comprises any statistically significant increase in the level of RNAi produced in a plant having the combined expression when compared to an appropriate control plant. For example, an increase in the level of RNAi in the plant, plant part or the plant cell can comprise at least about a 1%, about a 1%-5%, about a 5%-10%, about a 10%-20%, about a 20%-30%, about a 30%-40%, about a 40%-50%, about a 50%-60%, about 60-70%, about 70%-80%, about a 80%-90%, about a 90%-100% or greater increase in the level of RNAi in the plant, plant part, plant cell or phloem when compared to an appropriate control. In other embodiments, the increase in the level of RNAi in the plant, plant part, plant cell or phloem can comprise at least about a 1 fold, about a 1 fold-5 fold, about a 5 fold-10 fold, about a 10 fold-20 fold, about a 20 fold-30 fold, about a 30 fold-40 fold, about a 40 fold-50 fold, about a 50 fold-60 fold, about 60 fold-70 fold, about 70 fold-80 fold, about a 80 fold-90 fold, about a 90 fold-100 fold or greater increase in the level of RNAi in the plant, plant part, plant cell or phloem when compared to an appropriate control. Examples of combined expression of the silencing element with suppressor enhancer element for the control of Stinkbugs and *Lygus* can be found in US Patent Application Publication 2011/0301223 and US Patent Application Publication 2009/0192117.

Some embodiments relate to down-regulation of expression of target genes in insect pest species by interfering ribonucleic acid (RNA) molecules. PCT Publication WO 2007/074405 describes methods of inhibiting expression of target genes in invertebrate pests including Colorado potato beetle. PCT Publication WO 2005/110068 describes methods of inhibiting expression of target genes in invertebrate pests including Western corn rootworm to control insect infestation. Furthermore, PCT Publication WO 2009/091864 describes compositions and methods for the suppression of target genes from insect pest species including pests from the *Lygus* genus. Nucleic acid molecules including RNAi for targeting the vacuolar ATPase H subunit, useful for controlling a coleopteran pest population and infestation as described in US Patent Application Publication 2012/0198586. PCT Publication WO 2012/055982 describes ribonucleic acid (RNA or double stranded RNA) that inhibits or down regulates the expression of a target gene that encodes: an insect ribosomal protein such as the ribosomal protein L19, the ribosomal protein L40 or the ribosomal protein S27A; an insect proteasome subunit such as the Rpn6 protein, the Pros 25, the Rpn2 protein, the proteasome beta 1 subunit protein or the Pros beta 2 protein; an insect β-coatomer of the COPI vesicle, the γ-coatomer of the COPI vesicle, the β'-coatomer protein or the ζ-coatomer of the COPI vesicle; an insect Tetraspanine 2 A protein which is a putative transmembrane domain protein; an insect protein belonging to the actin family such as Actin 5C; an insect ubiquitin-5E protein; an insect Sec23 protein which is a GTPase activator involved in intracellular protein transport; an insect crinkled protein which is an unconventional myosin which is involved in motor activity; an insect crooked neck protein which is involved in the regulation of nuclear alternative mRNA splicing; an insect vacuolar H+-ATPase G-subunit protein and an insect Tbp-1 such as Tat-binding protein. PCT publication WO 2007/035650 describes ribonucleic acid (RNA or double stranded RNA) that inhibits or down regulates the expression of a target gene that encodes Snf7. US Patent Application publication 2011/0054007 describes polynucleotide silencing elements targeting RPS10. US Patent Application publications 2014/0275208 and US2015/0257389 describe polynucleotide silencing elements targeting RyanR and PAT3. PCT Patent Application publication WO2016/138106 describes polynucleotide silencing elements targeting coatomer alpha or gamma. US Patent Application Publications 2012/029750, US 20120297501, and 2012/0322660 describe interfering ribonucleic acids (RNA or double stranded RNA) that functions upon uptake by an insect pest species to down-regulate expression of a target gene in said insect pest, wherein the RNA comprises at least one silencing element wherein the silencing element is a region of double-stranded RNA comprising annealed complementary strands, one strand of which comprises or consists of a sequence of nucleotides which is at least partially complementary to a target nucleotide sequence within the target gene. US Patent Application Publication 2012/0164205 describe potential targets for interfering double stranded ribonucleic acids for inhibiting invertebrate pests including: a Chd3 Homologous Sequence, a Beta-Tubulin Homologous Sequence, a 40 kDa V-ATPase Homologous Sequence, a EF1a Homologous Sequence, a 26S Proteosome Subunit p28 Homologous Sequence, a Juvenile Hormone Epoxide Hydrolase Homologous Sequence, a Swelling Dependent Chloride Channel Protein Homologous Sequence, a Glucose-6-Phosphate 1-Dehydrogenase Protein Homologous Sequence, an Act42A Protein Homologous Sequence, a ADP-Ribosylation Factor 1 Homologous Sequence, a Transcription Factor IIB Protein Homologous Sequence, a Chitinase Homologous Sequences, a Ubiquitin Conjugating Enzyme Homologous Sequence, a Glyceraldehyde-3-Phosphate Dehydrogenase Homologous Sequence, an Ubiquitin B Homologous Sequence, a Juvenile Hormone Esterase Homolog, and an Alpha Tubuliln Homologous Sequence.

Use in Pesticidal Control

General methods for employing strains comprising a nucleic acid sequence of the embodiments or a variant thereof, in pesticide control or in engineering other organisms as pesticidal agents are known in the art.

Microorganism hosts that are known to occupy the "phytosphere" (phylloplane, phyllosphere, rhizosphere, and/or rhizoplana) of one or more crops of interest may be selected. These microorganisms are selected to be capable of successfully competing in the particular environment with the wild-type microorganisms, provide for stable maintenance and expression of the gene expressing the IPD113 polypeptide and desirably provide for improved protection of the pesticide from environmental degradation and inactivation.

Alternatively, the IPD113 polypeptide is produced by introducing a heterologous gene into a cellular host. Expression of the heterologous gene results, directly or indirectly, in the intracellular production and maintenance of the pesticide. These cells are then treated under conditions that prolong the activity of the toxin produced in the cell when the cell is applied to the environment of target pest(s). The resulting product retains the toxicity of the toxin. These naturally encapsulated IPD113 polypeptides may then be formulated in accordance with conventional techniques for application to the environment hosting a target pest, e.g., soil, water, and foliage of plants. See, for example EPA 0192319, and the references cited therein.

Pesticidal Compositions

In some embodiments, the active ingredients can be applied in the form of compositions and can be applied to the crop area or plant to be treated, simultaneously or in succession, with other compounds. These compounds can be fertilizers, weed killers, Cryoprotectants, surfactants, detergents, pesticidal soaps, dormant oils, polymers, and/or time-release or biodegradable carrier formulations that permit long-term dosing of a target area following a single application of the formulation. They can also be selective herbicides, chemical insecticides, virucides, microbicides, amoebicides, pesticides, fungicides, bacteriocides, nematocides, molluscicides or mixtures of several of these preparations, if desired, together with further agriculturally acceptable carriers, surfactants or application-promoting adjuvants customarily employed in the art of formulation. Suitable carriers and adjuvants can be solid or liquid and correspond to the substances ordinarily employed in formulation technology, e.g. natural or regenerated mineral substances, solvents, dispersants, wetting agents, tackifiers, binders or fertilizers. Likewise, the formulations may be prepared into edible "baits" or fashioned into pest "traps" to permit feeding or ingestion by a target pest of the pesticidal formulation.

Methods of applying an active ingredient or an agrochemical composition that contains at least one of the IPD113 polypeptide produced by the bacterial strains include leaf application, seed coating and soil application. The number of applications and the rate of application depend on the intensity of infestation by the corresponding pest.

The composition may be formulated as a powder, dust, pellet, granule, spray, emulsion, colloid, solution or such like, and may be prepared by such conventional means as desiccation, lyophilization, homogenation, extraction, filtration, centrifugation, sedimentation or concentration of a culture of cells comprising the polypeptide. In all such compositions that contain at least one such pesticidal polypeptide, the polypeptide may be present in a concentration of from about 1% to about 99% by weight.

Lepidopteran, Dipteran, Heteropteran, nematode, Hemiptera or Coleopteran pests may be killed or reduced in numbers in each area by the methods of the disclosure or may be prophylactically applied to an environmental area to prevent infestation by a susceptible pest. Preferably the pest ingests or is contacted with, a pesticidally-effective amount of the polypeptide. "Pesticidally-effective amount" as used herein refers to an amount of the pesticide that can bring about death to at least one pest or to noticeably reduce pest growth, feeding or normal physiological development. This amount will vary depending on such factors as, for example, the specific target pests to be controlled, the specific environment, location, plant, crop or agricultural site to be treated, the environmental conditions and the method, rate, concentration, stability, and quantity of application of the pesticidally-effective polypeptide composition. The formulations may also vary with respect to climatic conditions, environmental considerations, and/or frequency of application and/or severity of pest infestation.

The pesticide compositions described may be made by formulating the bacterial cell, Crystal and/or spore suspension or isolated protein component with the desired agriculturally-acceptable carrier. The compositions may be formulated prior to administration in an appropriate means such as lyophilized, freeze-dried, desiccated or in an aqueous carrier, medium or suitable diluent, such as saline or another buffer. The formulated compositions may be in the form of a dust or granular material or a suspension in oil (vegetable or mineral) or water or oil/water emulsions or as a wettable powder or in combination with any other carrier material suitable for agricultural application. Suitable agricultural carriers can be solid or liquid. The term "agriculturally-acceptable carrier" covers all adjuvants, inert components, dispersants, surfactants, tackifiers, binders, etc. that are ordinarily used in pesticide formulation technology. The formulations may be mixed with one or more solid or liquid adjuvants and prepared by various means, e.g., by homogeneously mixing, blending and/or grinding the pesticidal composition with suitable adjuvants using conventional formulation techniques. Suitable formulations and application methods are described in U.S. Pat. No. 6,468,523, herein incorporated by reference. The plants can also be treated with one or more chemical compositions, including one or more herbicide, insecticides or fungicides. Exemplary chemical compositions include: Fruits/Vegetables Herbicides: Atrazine, Bromacil, Diuron, Glyphosate, Linuron, Metribuzin, Simazine, Trifluralin, Fluazifop, Glufosinate, Halo sulfuron Gowan, Paraquat, Propyzamide, Sethoxydim, Butafenacil, Halosulfuron, Indaziflam; Fruits/Vegetables Insecticides: Aldicarb, *Bacillus* thuriengiensis, Carbaryl, Carbofuran, Chlorpyrifos, Cypermethrin, Deltamethrin, Diazinon, Malathion, Abamectin, Cyfluthrin/beta-cyfluthrin, Esfenvalerate, Lambda-cyhalothrin, Acequinocyl, Bifenazate, Methoxyfenozide, Novaluron, Chromafenozide, Thiacloprid, Dinotefuran, FluaCrypyrim, Tolfenpyrad, Clothianidin, Spirodiclofen, Gamma-cyhalothrin, Spiromesifen, Spinosad, Rynaxypyr, Cyazypyr, Spinoteram, Triflumuron, Spirotetramat, Imidacloprid, Flubendiamide, Thiodicarb, Metaflumizone, Sulfoxaflor, Cyflumetofen, Cyanopyrafen, Imidacloprid, Clothianidin, Thiamethoxam, Spinoteram, Thiodicarb, Flonicamid, Methiocarb, Emamectin-benzoate, Indoxacarb, Forthiazate, Fenamiphos, Cadusaphos, Pyriproxifen, Fenbutatin-oxid, Hexthiazox, Methomyl, 4-[[(6-Chlorpyridin-3-yl)methyl](2,2-difluorethyl)amino] furan-2(5H)-on; Fruits/Vegetables Fungicides: Carbendazim, Chlorothalonil, EBDCs, Sulphur, Thiophanate-methyl, Azoxystrobin, Cymoxanil, Fluazinam, Fosetyl, Iprodione, Kresoxim-methyl, Metalaxyl/mefenoxam, Trifloxystrobin, Ethaboxam, Iprovalicarb, Trifloxystrobin, Fenhexamid, Oxpoconazole fumarate, Cyazofamid, Fenamidone, Zoxamide, Picoxystrobin, Pyraclostrobin, Cyflufenamid, Boscalid; Cereals Herbicides: Isoproturon, Bromoxynil, Ioxynil, Phenoxies, Chlorsulfuron, Clodinafop, Diclofop, Diflufenican, Fenoxaprop, Florasulam, Fluoroxypyr, Metsulfuron, Triasulfuron, Flucarbazone, Iodosulfuron, Propoxycarbazone, Picolinafen, Mesosulfuron, Beflubutamid, Pinoxaden, Amidosulfuron, Thifensulfuron Methyl, Tribenuron, Flupyrsulfuron, Sulfosulfuron, Pyrasulfotole, Pyroxsulam, Flufenacet, Tralkoxydim, Pyroxasulfon; Cereals Fungicides: Carbendazim, Chlorothalonil, Azoxystrobin, Cyproconazole, Cyprodinil, Fenpropimorph, Epoxiconazole, Kresoxim-methyl, Quinoxyfen, Tebuconazole, Trifloxystrobin, Simeconazole, Picoxystrobin, Pyraclostrobin, Dimoxystrobin, Prothioconazole, Fluoxastrobin; Cereals Insecticides: Dimethoate, Lam bda-cyhalthrin, Deltamethrin, alpha-Cypermethrin, β-cyfluthrin, Bifenthrin, Imidacloprid, Clothianidin, Thiamethoxam, Thiacloprid, Acetamiprid, Dinotefuran, Clorphyriphos, Metamidophos, Oxidemethon-methyl, Pirimicarb, Methiocarb; Maize Herbicides: Atrazine, Alachlor, Bromoxynil, Acetochlor, Dicamba, Clopyralid, (S-) Dimethenamid, Glufosinate, Glyphosate, Isoxaflutole, (S-)Metolachlor, Mesotrione, Nicosulfuron, Primisulfuron, Rimsulfuron, Sulcotrione, Foramsulfuron, Topramezone, Tembotrione, Saflufenacil, Thiencarbazone, Flufenacet, Pyroxasulfon; Maize Insecticides: Carbofuran, Chlorpyrifos, Bifenthrin, Fipronil, Imidacloprid, Lambda-Cyhalothrin, Tefluthrin, Terbufos, Thiamethoxam, Clothianidin, Spiromesifen, Flubendiamide, Triflumuron, Rynaxypyr, Deltamethrin, Thiodicarb, β-Cyfluthrin, Cypermethrin, Bifenthrin, Lufenuron, Triflumoron, Tefluthrin, Tebupirimphos, Ethiprole, Cyazypyr, Thiacloprid, Acetamiprid, Dinetofuran, Avermectin, Methiocarb, Spirodiclofen, Spirotetramat; Maize Fungicides: Fenitropan, Thiram, Prothioconazole, Tebuconazole, Trifloxystrobin; Rice Herbicides: Butachlor, Propanil, Azimsulfuron, Bensulfuron, Cyhalofop, Daimuron, Fentrazamide, Imazosulfuron, Mefenacet, Oxaziclomefone, Pyrazosulfuron, Pyributicarb, Quinclorac, Thiobencarb, Indanofan, Flufenacet, Fentrazamide, Halosulfuron, Oxaziclomefone, Benzobicyclon, Pyriftalid, Penoxsulam, Bispyribac, Oxadiargyl, Ethoxysulfuron, Pretilachlor, Mesotrione, Tefuryltrione, Oxadiazone, Fenoxaprop, Pyrimisulfan; Rice Insecticides: Diazinon, Fenitrothion, Fenobucarb, Monocrotophos, Benfuracarb, Buprofezin, Dinotefuran, Fipronil, Imidacloprid, Isoprocarb, Thiacloprid, Chromafenozide, Thiacloprid, Dinotefuran, Clothianidin, Ethiprole, Flubendiamide, Rynaxypyr, Deltamethrin, Acetamiprid, Thiamethoxam, Cyazypyr, Spinosad, Spinotoram, Emamectin-Benzoate, Cypermethrin, Chlorpyriphos, Cartap, Methamidophos, Etofenprox, Triazophos, 4-[[(6-Chlorpyridin-3-yl)methyl](2,2-difluorethyl)amino]furan-2(5H)-on, Carbofuran, Benfuracarb; Rice Fungicides: Thiophanate-methyl, Azoxystrobin, Carpropamid, Edifenphos, Ferimzone, Iprobenfos, Isoprothiolane, Pencycuron, Probenazole, Pyroquilon, Tricyclazole, Trifloxystrobin, Diclocymet, Fenoxanil, Simeconazole, Tiadinil; Cotton Herbicides: Diuron, Fluometuron, MSMA, Oxyfluorfen, Prometryn, Trifluralin, Carfentrazone, Clethodim, Fluazifop-butyl, Glyphosate, Norflurazon, Pendimethalin, Pyrithiobac-sodium, Trifloxysulfuron, Tepraloxydim, Glufosinate, Flumioxazin, Thidiazuron; Cotton Insecticides: Acephate, Aldicarb, Chlorpyrifos, Cypermethrin, Deltamethrin, Malathion, Monocrotophos, Abamectin, Acetamiprid, Emamectin Benzoate, Imidacloprid, Indoxacarb, Lambda-Cyhalothrin, Spinosad, Thiodicarb, Gamma-Cyhalothrin, Spiromesifen, Pyridalyl, Flonicamid, Flubendiamide, Triflumuron, Rynaxypyr, Beta-Cyfluthrin, Spirotetramat, Clothianidin, Thiamethoxam, Thiacloprid, Dinetofuran, Flubendiamide, Cyazypyr, Spinosad, Spinotoram, gamma Cyhalothrin, 4-[[(6-Chlorpyridin-3-yl)methyl](2,2-difluorethyl)amino]furan-2(5H)-on, Thiodicarb, Avermectin, Flonicamid, Pyridalyl, Spiromesifen, Sulfoxaflor, Profenophos, Thriazophos, Endosulfan; Cotton Fungicides: Etridiazole, Metalaxyl, Quintozene; Soybean Herbicides: Alachlor, Bentazone, Trifluralin, Chlorimuron-Ethyl, Cloransulam-Methyl, Fenoxaprop, Fomesafen, Fluazifop, Glyphosate, Imazamox, Imazaquin, Imazethapyr, (S-)Metolachlor, Metribuzin, Pendimethalin, Tepraloxydim, Glufosinate; Soybean Insecticides: Lambda-cyhalothrin, Methomyl, Parathion, Thiocarb, Imidacloprid, Clothianidin, Thiamethoxam, Thiacloprid, Acetamiprid, Dinetofuran, Flubendiamide, Rynaxypyr, Cyazypyr, Spinosad, Spinotoram, Emamectin-Benzoate, Fipronil, Ethiprole, Deltamethrin, β-Cyfluthrin, gamma and lambda Cyhalothrin, 4-[[(6-Chlorpyridin-3-yl)methyl](2,2-difluorethyl)amino]furan-2 (5H)-on, Spirotetramat, Spinodiclofen, Triflumuron, Flonicamid, Thiodicarb, beta-Cyfluthrin; Soybean Fungicides: Azoxystrobin, Cyproconazole, Epoxiconazole, Flutriafol, Pyraclostrobin, Tebuconazole, Trifloxystrobin, Prothioconazole, Tetraconazole; Sugarbeet Herbicides: Chloridazon, Desmedipham, Ethofumesate, Phenmedipham, Triallate, Clopyralid, Fluazifop, Lenacil, Metamitron, Quinmerac, Cycloxydim, Triflusulfuron, Tepraloxydim, Quizalofop; Sugarbeet Insecticides: Imidacloprid, Clothianidin, Thiamethoxam, Thiacloprid, Acetamiprid, Dinetofuran, Deltamethrin, β-Cyfluthrin, gamma/lambda Cyhalothrin, 4-[[(6-Chlorpyridin-3-yl)methyl](2,2-difluorethyl)amino]furan-2(5H)-on, Tefluthrin, Rynaxypyr, Cyaxypyr, Fipronil, Carbofuran; Canola Herbicides: Clopyralid, Diclofop, Fluazifop, Glufosinate, Glyphosate, Metazachlor, Trifluralin Ethametsulfuron, Quinmerac, Quizalofop, Clethodim, Tepraloxydim; Canola Fungicides: Azoxystrobin, Carbendazim, Fludioxonil, Iprodione, Prochloraz, Vinclozolin; Canola Insecticides: Carbofuran organophosphates, Pyrethroids, Thiacloprid, Deltamethrin, Imidacloprid, Clothianidin, Thiamethoxam, Acetamiprid, Dinetofuran, β-Cyfluthrin, gamma and lambda Cyhalothrin, tau-Fluvaleriate, Ethiprole, Spinosad, Spinotoram, Flubendiamide, Rynaxypyr, Cyazypyr, 4-[[(6-Chlorpyridin-3-yl)methyl](2,2-difluorethyl)amino]furan-2(5H)-on.

In some embodiments, the herbicide is Atrazine, Bromacil, Diuron, Chlorsulfuron, Metsulfuron, Thifensulfuron Methyl, Tribenuron, Acetochlor, Dicamba, Isoxaflutole, Nicosulfuron, Rimsulfuron, Pyrithiobac-sodium, Flumioxazin, Chlorimuron-Ethyl, Metribuzin, Quizalofop, S-metolachlor, Hexazinne or combinations thereof.

In some embodiments, the insecticide is Esfenvalerate, Chlorantraniliprole, Methomyl, Indoxacarb, Oxamyl or combinations thereof.

Pesticidal and Insecticidal Activity

"Pest" includes but is not limited to, insects, fungi, bacteria, nematodes, mites, ticks and the like. Insect pests include insects selected from the orders Coleoptera, Diptera, Hymenoptera, Lepidoptera, Mallophaga, Homoptera, Hemiptera Orthroptera, Thysanoptera, Dermaptera, Isoptera, Anoplura, Siphonaptera, Trichoptera, etc., particularly Lepidoptera and Coleoptera.

Those skilled in the art will recognize that not all compounds are equally effective against all pests. Compounds of the embodiments display activity against insect pests, which may include economically important agronomic, forest, greenhouse, nursery ornamentals, food and fiber, public and animal health, domestic and commercial structure, household and stored product pests.

Larvae of the order Lepidoptera include, but are not limited to, armyworms, cutworms, loopers and heliothines in the family Noctuidae *Spodoptera frugiperda* JE Smith (fall armyworm); *S. exigua* Hübner (beet armyworm); *S. litura* Fabricius (tobacco cutworm, cluster caterpillar); *Mamestra configurata* Walker (bertha armyworm); *M. brassicae* Linnaeus (cabbage moth); *Agrotis ipsilon* Hufnagel (black cutworm); *A. orthogonia* Morrison (western cutworm); *A. subterranea* Fabricius (granulate cutworm); *Alabama argillacea* Hübner (cotton leaf worm); *Trichoplusia ni* Hübner (cabbage looper); *Pseudoplusia includens* Walker (soybean looper); *Anticarsia gemmatalis* Hübner (velvetbean caterpillar); *Hypena scabra* Fabricius (green cloverworm); *Heliothis virescens* Fabricius (tobacco budworm); *Pseudaletia unipuncta* Haworth (armyworm); *Athetis mindara* Barnes and Mcdunnough (rough skinned cutworm); *Euxoa messoria* Harris (darksided cutworm); *Earias insulana* Boisduval (spiny bollworm); *E. vittella* Fabricius (spotted bollworm); *Helicoverpa armigera* Hübner (American bollworm); *H. zea* Boddie (corn earworm or cotton bollworm); *Melanchra picta* Harris (zebra caterpillar); *Egira* (*Xylomyges*) *curialis* Grote (citrus cutworm); borers, casebearers, webworms, coneworms, and skeletonizers from the family Pyralidae *Ostrinia nubilalis* Hübner (European corn borer); *Amyelois transitella* Walker (naval orangeworm); *Anagasta kuehniella* Zeller (Mediterranean flour moth); *Cadra cautella* Walker (almond moth); *Chilo suppressalis* Walker (rice stem borer); *C. partellus*, (sorghum borer); *Corcyra cephalonica* Stainton (rice moth); *Crambus caliginosellus* Clemens (corn root webworm); *C. teterrellus* Zincken (bluegrass webworm); *Cnaphalocrocis medinalis* Guenée (rice leaf roller); *Desmia funeralis* Hübner (grape leaffolder); *Diaphania hyalinata* Linnaeus (melon worm); *D. nitidalis* Stoll (pickleworm); *Diatraea grandiosella* Dyar (southwestern corn borer); *D. saccharalis* Fabricius (surgarcane borer); *Eoreuma loftini* Dyar (Mexican rice borer); *Ephestia elutella* Hübner (tobacco (cacao) moth); *Galleria mellonella* Linnaeus (greater wax moth); *Herpetogramma licarsisalis* Walker (sod webworm); *Homoeosoma electellum* Hulst (sunflower moth); *Elasmopalpus lignosellus* Zeller (lesser cornstalk borer); *Achroia grisella* Fabricius (lesser wax moth); *Loxostege sticticalis* Linnaeus (*beet webworm*); *Orthaga thyrisalis* Walker (tea tree web moth); *Maruca testulalis* Geyer (bean pod borer); *Plodia interpunctella* Hübner (Indian meal moth); *Scirpophaga incertulas* Walker (yellow stem borer); *Udea rubigalis* Guenée (celery leaftier); and leafrollers, budworms, seed worms and fruit worms in the family Tortricidae Acleris gloverana Walsingham (Western blackheaded budworm); *A. variana* Fernald (Eastern blackheaded budworm); *Archips argyrospila* Walker (fruit tree leaf roller); *A. rosana* Linnaeus (European leaf roller); and other *Archips* species, *Adoxophyes orana* Fischer von Rösslerstamm (summer fruit tortrix moth); *Cochylis hospes* Walsingham (banded sunflower moth); *Cydia latiferreana* Walsingham (filbertworm); *C. pomonella* Linnaeus (coding moth); *Platynota flavedana* Clemens (variegated leafroller); *P. stultana* Walsingham (omnivorous leafroller); *Lobesia botrana* Denis & Schiffermüller (European grape vine moth); *Spilonota ocellana* Denis & Schiffermüller (eyespotted bud moth); *Endopiza viteana* Clemens (grape berry moth); *Eupoecilia ambiguella* Hübner (vine moth); *Bonagota salubricola* Meyrick (Brazilian apple leafroller); *Grapholita molesta* Busck (oriental fruit moth); *Suleima helianthana* Riley (sunflower bud moth); *Argyrotaenia* spp.; and *Choristoneura* spp.

Selected other agronomic pests in the order Lepidoptera include, but are not limited to, *Alsophila pometaria* Harris (fall cankerworm); *Anarsia lineatella* Zeller (peach twig borer); *Anisota senatoria* J. E. Smith (orange striped oakworm); *Antheraea pernyi* Guérin-Meneville (Chinese Oak Tussah Moth); *Bombyx mori* Linnaeus (Silkworm); *Bucculatrix thurberiella* Busck (cotton leaf perforator); *Colias eurytheme* Boisduval (alfalfa caterpillar); *Datana integerrima* Grote & Robinson (walnut caterpillar); *Dendrolimus sibiricus* Tschetwerikov (Siberian silk moth), *Ennomos subsignaria* Hübner (elm spanworm); *Erannis tiliaria* Harris (linden looper); *Euproctis chlysorrhoea* Linnaeus (browntail moth); *Harrisina americana* Guérin-Meneville (grapeleaf skeletonizer); *Hemileuca oliviae* Cockrell (range caterpillar); *Hyphantria cunea* Drury (fall webworm); *Keiferia lycopersicella* Walsingham (tomato pinworm); *Lambdina fiscellaria fiscellaria* Hulst (Eastern hemlock looper); *L. fiscellaria lugubrosa* Hulst (Western hemlock looper); *Leucoma salicis* Linnaeus (satin moth); *Lymantria dispar* Linnaeus (gypsy moth); *Manduca quinquemaculata* Haworth (five spotted hawk moth, tomato hornworm); *M. sexta* Haworth (tomato hornworm, tobacco hornworm); *Operophtera brumata* Linnaeus (winter moth); *Paleacrita vernata* Peck (spring cankerworm); *Papilio cresphontes* Cramer (giant swallowtail orange dog); *Phryganidia californica* Packard (California oakworm); *Phyllocnistis citrella* Stainton (citrus leafminer); *Phyllonorycter blancardella* Fabricius (spotted tentiform leafminer); *Pieris brassicae* Linnaeus (large white butterfly); *P. rapae* Linnaeus (small white butterfly); *P. napi* Linnaeus (green veined white butterfly); *Platyptilia carduidactyla* Riley (artichoke plume moth);

*Plutella xylostella* Linnaeus (diamondback moth); *Pectinophora gossypiella* Saunders (pink bollworm); *Pontia protodice* Boisduval and Leconte (Southern cabbageworm); *Sabulodes aegrotata* Guenée (omnivorous looper); *Schizura concinna* J. E. Smith (red humped caterpillar); *Sitotroga cerealella* Olivier (Angoumois grain moth); *Thaumetopoea pityocampa* Schiffermüller (pine processionary caterpillar); *Tineola bisselliella* Hummel (webbing clothesmoth); *Tuta absoluta* Meyrick (tomato leafminer); *Yponomeuta padella* Linnaeus (ermine moth); *Heliothis subflexa* Guenée; *Malacosoma* spp. and *Orgyia* spp.

Of interest are larvae and adults of the order Coleoptera including weevils from the families Anthribidae, Bruchidae and Curculionidae (including, but not limited to: *Anthonomus grandis* Boheman (boll weevil); *Lissorhoptrus oryzophilus* Kuschel (rice water weevil); *Sitophilus granarius* Linnaeus (granary weevil); *S. oryzae* Linnaeus (rice weevil); *Hypera punctata* Fabricius (clover leaf weevil); *Cylindrocopturus adspersus* LeConte (sunflower stem weevil); *Smicronyx fulvus* LeConte (red sunflower seed weevil); *S. sordidus* LeConte (gray sunflower seed weevil); *Sphenophorus maidis* Chittenden (maize billbug)); flea beetles, cucumber beetles, rootworms, leaf beetles, potato beetles and leafminers in the family Chrysomelidae (including, but not limited to: *Leptinotarsa decemlineata* Say (Colorado potato beetle); *Diabrotica virgifera virgifera* LeConte (western corn rootworm); *D. barberi* Smith and Lawrence (northern corn rootworm); *D. undecimpunctata howardi* Barber (southern corn rootworm); *Chaetocnema pulicaria* Melsheimer (corn flea beetle); *Phyllotreta cruciferae* Goeze (Crucifer flea beetle); *Phyllotreta striolata* (stripped flea beetle); *Colaspis brunnea* Fabricius (grape colaspis); *Oulema melanopus* Linnaeus (cereal leaf beetle); *Zygogramma exclamationis* Fabricius (sunflower beetle)); beetles from the family Coccinellidae (including, but not limited to: *Epilachna varivestis* Mulsant (Mexican bean beetle)); chafers and other beetles from the family Scarabaeidae (including, but not limited to: *Popillia japonica* Newman (Japanese beetle); *Cyclocephala borealis* Arrow (northern masked chafer, white grub); *C. immaculata* Olivier (southern masked chafer, white grub); *Rhizotrogus majalis* Razoumowsky (European chafer); *Phyllophaga crinita* Burmeister (white grub); *Ligyrus gibbosus* De Geer (carrot beetle)); carpet beetles from the family Dermestidae; wireworms from the family Elateridae, *Eleodes* spp., *Melanotus* spp.; *Conoderus* spp.; *Limonius* spp.; *Agriotes* spp.; *Ctenicera* spp.; *Aeolus* spp.; bark beetles from the family Scolytidae and beetles from the family Tenebrionidae.

Adults and immatures of the order Diptera are of interest, including leafminers *Agromyza parvicomis* Loew (corn blotch leafminer); midges (including, but not limited to: *Contarinia sorghicola* Coquillett (sorghum midge); *Mayetiola destructor* Say (Hessian fly); *Sitodiplosis mosellana* Géhin (wheat midge); *Neolasioptera murtfeldtiana* Felt, (sunflower seed midge)); fruit flies (Tephritidae), *Oscinella frit* Linnaeus (fruit flies); maggots (including, but not limited to: *Delia platura* Meigen (seedcorn maggot); *D. coarctata* Fallen (wheat bulb fly) and other *Delia* spp., *Meromyza americana* Fitch (wheat stem maggot); *Musca domestica* Linnaeus (house flies); *Fannia canicularis* Linnaeus, *F. femoralis* Stein (lesser house flies); *Stomoxys calcitrans* Linnaeus (stable flies)); face flies, horn flies, blow flies, *Chrysomya* spp.; *Phormia* spp. and other muscoid fly pests, horse flies *Tabanus* spp.; bot flies *Gastrophilus* spp.; *Oestrus* spp.; cattle grubs *Hypoderma* spp.; deer flies *Chrysops* spp.; *Melophagus ovinus* Linnaeus (keds) and other Brachycera, mosquitoes *Aedes* spp.; *Anopheles* spp.; *Culex* spp.; black flies *Prosimulium* spp.; *Simulium* spp.; biting midges, sand flies, sciarids, and other Nematocera.

Included as insects of interest are adults and nymphs of the orders Hemiptera and Homoptera such as, but not limited to, adelgids from the family Adelgidae, plant bugs from the family Miridae, cicadas from the family Cicadidae, leafhoppers, *Empoasca* spp.; from the family Cicadellidae, planthoppers from the families Cixiidae, Flatidae, Fulgoroidea, lssidae and Delphacidae, treehoppers from the family Membracidae, psyllids from the family Psyllidae, whiteflies from the family Aleyrodidae, aphids from the family Aphididae, phylloxera from the family Phylloxeridae, mealybugs from the family Pseudococcidae, scales from the families Asterolecanidae, Coccidae, Dactylopiidae, Diaspididae, Eriococcidae Ortheziidae, Phoenicococcidae and Margarodidae, lace bugs from the family Tingidae, stink bugs from the family Pentatomidae, cinch bugs, *Blissus* spp.; and other seed bugs from the family Lygaeidae, spittlebugs from the family Cercopidae squash bugs from the family Coreidae and red bugs and cotton stainers from the family Pyrrhocoridae.

Agronomically important members from the order Homoptera further include, but are not limited to: *Acyrthisiphon pisum* Harris (pea aphid); *Aphis craccivora* Koch (cowpea aphid); *A. fabae* Scopoli (black bean aphid); *A. gossypii* Glover (cotton aphid, melon aphid); A. maidiradicis Forbes (corn root aphid); *A. pomi* De Geer (apple aphid); *A. spiraecola* Patch (spirea aphid); *Aulacorthum solani* Kaltenbach (foxglove aphid); *Chaetosiphon fragaefolii* Cockerell (strawberry aphid); *Diuraphis noxia* Kurdjumov/Mordvilko (Russian wheat aphid); *Dysaphis plantaginea* Paaserini (rosy apple aphid); *Eriosoma lanigerum* Hausmann (woolly apple aphid); *Brevicoryne brassicae* Linnaeus (cabbage aphid); *Hyalopterus pruni* Geoffroy (mealy plum aphid); *Lipaphis erysimi* Kaltenbach (turnip aphid); *Metopolophium dirrhodum* Walker (cereal aphid); *Macrosiphum euphorbiae* Thomas (potato aphid); *Myzus persicae* Sulzer (peach-potato aphid, green peach aphid); *Nasonovia ribisnigri* Mosley (lettuce aphid); *Pemphigus* spp. (root aphids and gall aphids); *Rhopalosiphum maidis* Fitch (corn leaf aphid); *R. padi* Linnaeus (bird cherry-oat aphid); *Schizaphis graminum* Rondani (greenbug); *Sipha flava* Forbes (yellow sugarcane aphid); *Sitobion avenae* Fabricius (English grain aphid); *Therioaphis maculata* Buckton (spotted alfalfa aphid); *Toxoptera aurantii* Boyer de Fonscolombe (black citrus aphid) and *T. citricida* Kirkaldy (brown citrus aphid); *Adelges* spp. (adelgids); *Phylloxera devastatrix* Pergande (pecan *phylloxera*); *Bemisia tabaci* Gennadius (tobacco whitefly, sweetpotato whitefly); *B. argentifolii* Bellows & Perring (silverleaf whitefly); *Dialeurodes citri* Ashmead (citrus whitefly); *Trialeurodes abutiloneus* (bandedwinged whitefly) and *T. vaporariorum* Westwood (greenhouse whitefly); *Empoasca fabae* Harris (potato leafhopper); *Laodelphax striatellus* Fallen (smaller brown planthopper); *Macrolestes quadrilineatus* Forbes (aster leafhopper); *Nephotettix cinticeps* Uhler (green leafhopper); *N. nigropictus* Stål (rice leafhopper); *Nilaparvata lugens* Stål (brown planthopper); *Peregrinus maidis* Ashmead (corn planthopper); *Sogatella furcifera* Horvath (white-backed planthopper); *Sogatodes orizicola* Muir (rice delphacid); *Typhlocyba pomaria* McAtee (white apple leafhopper); *Erythroneoura* spp. (grape leafhoppers); *Magicicada septendecim* Linnaeus (periodical cicada); *Icerya purchasi* Maskell (cottony cushion scale); *Quadraspidiotus perniciosus* Comstock (San Jose scale); *Planococcus citri* Risso (citrus mealybug); *Pseudococcus* spp. (other mealybug complex); *Cacopsylla pyricola* Foerster (pear psylla); *Trioza diospyri* Ashmead (persimmon psylla).

Agronomically important species of interest from the order Hemiptera include, but are not limited to: *Acrosternum hi/are* Say (green stink bug); *Anasa tristis* De Geer (squash bug); *Blissus leucopterus leucopterus* Say (chinch bug); *Corythuca gossypii* Fabricius (cotton lace bug); *Cyrtopeltis modesta* Distant (tomato bug); *Dysdercus suturellus* Herrich-Schïffer (cotton stainer); *Euschistus servus* Say (brown stink bug); *E. variolarius* Palisot de Beauvois (one-spotted stink bug); *Graptostethus* spp. (complex of seed bugs); *Leptoglossus corculus* Say (leaf-footed pine seed bug); *Lygus lineolaris* Palisot de Beauvois (tarnished plant bug); *L. Hesperus* Knight (Western tarnished plant bug); *L. pratensis* Linnaeus (common meadow bug); *L. rugulipennis* Poppius (European tarnished plant bug); *Lygocoris pabulinus* Linnaeus (common green capsid); *Nezara viridula* Linnaeus (southern green stink bug); *Oebalus pugnax* Fabricius (rice stink bug); *Oncopeltus fasciatus* Dallas (large milkweed bug); *Pseudatomoscelis seriatus* Reuter (cotton fleahopper).

Furthermore, embodiments may be effective against Hemiptera such, *Calocoris norvegicus* Gmelin (strawberry bug); *Orthops campestris* Linnaeus; *Plesiocoris rugicollis* Fallen (apple capsid); *Cyrtopeltis modestus* Distant (tomato bug); *Cyrtopeltis notatus* Distant (suckfly); *Spanagonicus albofasciatus* Reuter (whitemarked fleahopper); *Diaphnocoris chlorionis* Say (honeylocust plant bug); *Labopidicola allii* Knight (onion plant bug); *Pseudatomoscelis seriatus* Reuter (cotton fleahopper); *Adelphocoris rapidus* Say (rapid plant bug); *Poecilocapsus lineatus* Fabricius (four-lined plant bug); *Nysius ericae* Schilling (false chinch bug); *Nysius raphanus* Howard (false chinch bug); *Nezara viridula* Linnaeus (Southern green stink bug); *Eurygaster* spp.; Coreidae spp.; Pyrrhocoridae spp.; Tinidae spp.; Blostomatidae spp.; Reduviidae spp. and Cimicidae spp.

Also included are adults and larvae of the order Acari (mites) such as *Aceria tosiche/la* Keifer (wheat curl mite); *Petrobia latens* Müller (brown wheat mite); spider mites and red mites in the family Tetranychidae, *Panonychus ulmi* Koch (European red mite); *Tetranychus urticae* Koch (two spotted spider mite); (*T. mcdanieli* McGregor (McDaniel mite); *T. cinnabarinus* Boisduval (carmine spider mite); *T. turkestani* Ugarov & Nikolski (strawberry spider mite); flat mites in the family Tenuipalpidae, *Brevipalpus lewisi* McGregor (citrus flat mite); rust and bud mites in the family Eriophyidae and other foliar feeding mites and mites important in human and animal health, i.e., dust mites in the family Epidermoptidae, follicle mites in the family Demodicidae, grain mites in the family Glycyphagidae, ticks in the order Ixodidae. *Ixodes scapularis* Say (deer tick); *I. holocyclus* Neumann (Australian paralysis tick); *Dermacentor variabilis* Say (American dog tick); *Amblyomma americanum* Linnaeus (lone star tick) and scab and itch mites in the families Psoroptidae, Pyemotidae and Sarcoptidae.

Insect pests of the order Thysanura are of interest, such as *Lepisma saccharina* Linnaeus (silverfish); *Thermobia domestica* Packard (firebrat).

Additional arthropod pests covered include: spiders in the order Araneae such as *Loxosceles reclusa* Gertsch and Mulaik (brown recluse spider) and the *Latrodectus mactans* Fabricius (black widow spider) and centipedes in the order Scutigeromorpha such as *Scutigera coleoptrata* Linnaeus (house centipede).

Insect pest of interest include the superfamily of stink bugs and other related insects including but not limited to species belonging to the family Pentatomidae (*Nezara viridula, Halyomorpha halys, Piezodorus guildini, Euschistus servus, Acrosternum hilare, Euschistus heros, Euschistus tristigmus, Acrosternum hilare, Dichelops furcatus, Dichelops melacanthus,* and *Bagrada hilaris* (Bagrada Bug)), the family Plataspidae (*Megacopta cribraria*—Bean plataspid) and the family Cydnidae (*Scaptocoris castanea*—Root stink bug) and Lepidoptera species including but not limited to: diamond-back moth, e.g., *Helicoverpa zea* Boddie; soybean looper, e.g., *Pseudoplusia includens* Walker and velvet bean caterpillar e.g., *Anticarsia gemmatalis* Hübner.

Methods for measuring pesticidal activity are well known in the art. See, for example, Czapla and Lang, (1990) *J. Econ. Entomol.* 83:2480-2485; Andrews, et al., (1988) *Biochem. J.* 252:199-206; Marrone, et al., (1985) *J. of Economic Entomology* 78:290-293 and U.S. Pat. No. 5,743,477, all of which are herein incorporated by reference in their entirety. Generally, the protein is mixed and used in feeding assays. See, for example Marrone, et al., (1985) *J. of Economic Entomology* 78:290-293. Such assays can include contacting plants with one or more pests and determining the plant's ability to survive and/or cause the death of the pests.

Nematodes include parasitic nematodes such as root-knot, cyst and lesion nematodes, including *Heterodera* spp., *Meloidogyne* spp. and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode) and *Globodera rostochiensis* and *Globodera pailida* (potato cyst nematodes). Lesion nematodes include *Pratylenchus* spp.

Seed Treatment

To protect and to enhance yield production and trait technologies, seed treatment options can provide additional crop plan flexibility and cost effective control against insects, weeds and diseases. Seed material can be treated, typically surface treated, with a composition comprising combinations of chemical or biological herbicides, herbicide safeners, insecticides, fungicides, germination inhibitors and enhancers, nutrients, plant growth regulators and activators, bactericides, nematocides, avicides and/or molluscicides. These compounds are typically formulated together with further carriers, surfactants or application-promoting adjuvants customarily employed in the art of formulation. The coatings may be applied by impregnating propagation material with a liquid formulation or by coating with a combined wet or dry formulation. Examples of the various types of compounds that may be used as seed treatments are provided in The Pesticide Manual: A World Compendium, C. D. S. Tomlin Ed., Published by the British Crop Production Council, which is hereby incorporated by reference.

Some seed treatments that may be used on crop seed include, but are not limited to, one or more of abscisic acid, acibenzolar-S-methyl, avermectin, amitrol, azaconazole, azospirillum, azadirachtin, azoxystrobin, *Bacillus* spp. (including one or more of *cereus, firmus, megaterium, pumilis, sphaericus, subtilis* and/or *thuringiensis* species), bradyrhizobium spp. (including one or more of *betae, canariense, elkanii, iriomotense, japonicum, liaonigense, pachyrhizi* and/or *yuanmingense*), captan, carboxin, chitosan, clothianidin, copper, cyazypyr, difenoconazole, etidiazole, fipronil, fludioxonil, fluoxastrobin, fluquinconazole, flurazole, fluxofenim, harpin protein, imazalil, imidacloprid, ipconazole, isoflavenoids, lipo-chitooligosaccharide, mancozeb, manganese, maneb, mefenoxam, metalaxyl, metconazole, myclobutanil, PCNB, penflufen, *penicillium*, penthiopyrad, permethrine, picoxystrobin, prothioconazole, pyraclostrobin, rynaxypyr, S-metolachlor, saponin, sedaxane, TCMTB, tebuconazole, thiabendazole, thiamethoxam, thiocarb, thiram, tolclofos-methyl, triadimenol, *trichoderma*, trifloxystrobin, triticonazole and/or zinc. PCNB seed coat refers to EPA Registration Number 00293500419, containing quintozen and terrazole. TCMTB refers to 2-(thiocyanomethylthio) benzothiazole.

Seed varieties and seeds with specific transgenic traits may be tested to determine which seed treatment options and application rates may complement such varieties and transgenic traits to enhance yield. For example, a variety with good yield potential but head smut susceptibility may benefit from the use of a seed treatment that provides protection against head smut, a variety with good yield potential but cyst nematode susceptibility may benefit from the use of a seed treatment that provides protection against cyst nematode, and so on. Likewise, a variety encompassing a transgenic trait conferring insect resistance may benefit from the second mode of action conferred by the seed treatment, a variety encompassing a transgenic trait conferring herbicide resistance may benefit from a seed treatment with a safener that enhances the plants resistance to that herbicide, etc. Further, the good root establishment and early emergence that results from the proper use of a seed treatment may result in more efficient nitrogen use, a better ability to withstand drought and an overall increase in yield potential of a variety or varieties containing a certain trait when combined with a seed treatment.

Methods for Killing an Insect Pest and Controlling an Insect Population

In some embodiments, methods are provided for killing an insect pest, comprising contacting the insect pest, either simultaneously or sequentially, with an insecticidally-effective amount of a recombinant IPD113 polypeptide or IPD113 chimeric polypeptide of the disclosure. In some embodiments, methods are provided for killing an insect pest, comprising contacting the insect pest with an insecticidally-effective amount of a recombinant pesticidal protein of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495 or a variant thereof.

In some embodiments, methods are provided for controlling an insect pest population, comprising contacting the insect pest population, either simultaneously or sequentially, with an insecticidally-effective amount of a recombinant IPD113 polypeptide or IPD113 chimeric polypeptide of the disclosure. In some embodiments, methods are provided for controlling an insect pest population, comprising contacting the insect pest population with an insecticidally-effective amount of a recombinant IPD113 polypeptide of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495 or a variant thereof. As used herein, "controlling a pest population" or "controls a pest" refers to any effect on a pest that results in limiting the damage that the pest causes. Controlling a pest includes, but is not limited to, killing the pest, inhibiting development of the pest, altering fertility or growth of the pest in such a manner that the pest provides less damage to the plant, decreasing the number of offspring produced, producing less fit pests, producing pests more susceptible to predator attack or deterring the pests from eating the plant.

In some embodiments, methods are provided for controlling an insect pest population resistant to a pesticidal protein, comprising contacting the insect pest population, either simultaneously or sequentially, with an insecticidally-effective amount of a recombinant IPD113 polypeptide or chimeric IPD113 polypeptide of the disclosure. In some embodiments, methods are provided for controlling an insect pest population resistant to a pesticidal protein, comprising contacting the insect pest population with an insecticidally-effective amount of a recombinant IPD113 polypeptide of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495 or a variant thereof.

In some embodiments, methods are provided for protecting a plant from an insect pest, comprising expressing in the plant or cell thereof at least one recombinant polynucleotide encoding an IPD113 polypeptide or chimeric IPD113 polypeptide. In some embodiments, methods are provided for protecting a plant from an insect pest, comprising expressing in the plant or cell thereof a recombinant polynucleotide encoding IPD113 polypeptide of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495 or variants thereof.

Insect Resistance Management (IRM) Strategies

Expression of *B. thuringiensis* δ-endotoxins in transgenic corn plants has proven to be an effective means of controlling agriculturally important insect pests (Perlak, et al., 1990; 1993). However, insects have evolved that are resistant to *B. thuringiensis* δ-endotoxins expressed in transgenic plants. Such resistance, should it become widespread, would clearly limit the commercial value of germplasm containing genes encoding such *B. thuringiensis* δ-endotoxins.

One way to increasing the effectiveness of the transgenic insecticides against target pests and contemporaneously reducing the development of insecticide-resistant pests is to use provide non-transgenic (i.e., non-insecticidal protein) refuges (a section of non-insecticidal crops/corn) for use with transgenic crops producing a single insecticidal protein active against target pests. The United States Environmental Protection Agency (epa.gov/oppbppdl/biopesticides/pips/bt_corn_refuge_2006.htm, which can be accessed using the www prefix) publishes the requirements for use with transgenic crops producing a single Bt protein active against target pests. In addition, the National Corn Growers Association, on their website: (ncga.com/insect-resistance-management-fact-sheet-bt-corn, which can be accessed using the www prefix) also provides similar guidance regarding refuge requirements. Due to losses to insects within the refuge area, larger refuges may reduce overall yield.

Another way of increasing the effectiveness of the transgenic insecticides against target pests and contemporaneously reducing the development of insecticide-resistant pests would be to have a repository of insecticidal genes that are effective against groups of insect pests and which manifest their effects through different modes of action.

Expression in a plant of two or more insecticidal compositions toxic to the same insect species, each insecticide being expressed at efficacious levels would be another way to achieve control of the development of resistance. This is based on the principle that evolution of resistance against two separate modes of action is far more unlikely than only one. Roush, for example, outlines two-toxin strategies, also called "pyramiding" or "stacking," for management of insecticidal transgenic crops. (The Royal Society. Phil. Trans. R. Soc. Lond. B. (1998) 353:1777-1786). Stacking or pyramiding of two different proteins each effective against the target pests and with little or no cross-resistance can allow for use of a smaller refuge. The US Environmental Protection Agency requires significantly less (generally 5%) structured refuge of non-Bt corn be planted than for single trait products (generally 20%). There are various ways of providing the IRM effects of a refuge, including various geometric planting patterns in the fields and in-bag seed mixtures, as discussed further by Roush.

In some embodiments, the IPD113 polypeptides of the disclosure are useful as an insect resistance management strategy in combination (i.e., pyramided) with other pesticidal proteins include but are not limited to Bt toxins, *Xenorhabdus* sp. or *Photorhabdus* sp. insecticidal proteins, other insecticidally active proteins, and the like.

Provided are methods of controlling Lepidoptera and/or Coleoptera insect infestation(s) in a transgenic plant that promote insect resistance management, comprising expressing in the plant at least two different insecticidal proteins having different modes of action.

In some embodiments, the methods of controlling Lepidoptera and/or Coleoptera insect infestation in a transgenic plant and promoting insect resistance management comprises the presentation of at least one of the IPD113 polypeptide insecticidal proteins to insects in the order Lepidoptera and/or Coleoptera.

In some embodiments, the methods of controlling Lepidoptera and/or Coleoptera insect infestation in a transgenic plant and promoting insect resistance management comprises the presentation of at least one of the IPD113 polypeptides of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319 or SEQ ID NO: 320 or variants thereof, insecticidal to insects in the order Lepidoptera and/or Coleoptera.

In some embodiments, the methods of controlling Lepidoptera and/or Coleoptera insect infestation in a transgenic plant and promoting insect resistance management comprise expressing in the transgenic plant an IPD113 polypeptide and a Cry protein or other insecticidal protein to insects in the order Lepidoptera and/or Coleoptera having different modes of action.

In some embodiments, the methods, of controlling Lepidoptera and/or Coleoptera insect infestation in a transgenic plant and promoting insect resistance management, comprise expression in the transgenic plant an IPD113 polypeptide of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495 or variants thereof and a Cry protein or other insecticidal protein to insects in the order Lepidoptera and/or Coleoptera, where the IPD113 polypeptide and Cry protein have different modes of action.

Also provided are methods of reducing likelihood of emergence of Lepidoptera and/or Coleoptera insect resistance to transgenic plants expressing in the plants insecticidal proteins to control the insect species, comprising expression of an IPD113 polypeptide insecticidal to the insect species in combination with a second insecticidal protein to the insect species having different modes of action.

Also provided are means for effective Lepidoptera and/or Coleoptera insect resistance management of transgenic plants, comprising co-expressing at high levels in the plants two or more insecticidal proteins toxic to Lepidoptera and/or Coleoptera insects but each exhibiting a different mode of effectuating its killing activity, wherein the two or more insecticidal proteins comprise an IPD113 polypeptide and a Cry protein. Also provided are means for effective Lepidoptera and/or Coleoptera insect resistance management of transgenic plants, comprising co-expressing at high levels in the plants two or more insecticidal proteins toxic to Lepidoptera and/or Coleoptera insects but each exhibiting a different mode of effectuating its killing activity, wherein the two or more insecticidal proteins comprise an IPD113 polypeptide of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495 or variants thereof and a Cry protein or other insecticidally active protein.

In addition, methods are provided for obtaining regulatory approval for planting or commercialization of plants expressing proteins insecticidal to insects in the order Lepidoptera and/or Coleoptera, comprising the step of referring to, submitting or relying on insect assay binding data showing that the IPD113 polypeptide does not compete with binding sites for Cry proteins in such insects. In addition, methods are provided for obtaining regulatory approval for planting or commercialization of plants expressing proteins insecticidal to insects in the order Lepidoptera and/or Coleoptera, comprising the step of referring to, submitting or relying on insect assay binding data showing that the IPD113 polypeptide of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 416, SEQ ID NO: 419, SEQ ID NO: 420, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 438, SEQ ID NO: 439, SEQ ID NO: 440, SEQ ID NO: 441, SEQ ID NO: 443, SEQ ID NO: 445, SEQ ID NO: 447, SEQ ID NO: 448, SEQ ID NO: 450, SEQ ID NO: 451, SEQ ID NO: 452, SEQ ID NO: 453, SEQ ID NO: 458, SEQ ID NO: 460, SEQ ID NO: 461, SEQ ID NO: 463, SEQ ID NO: 466, SEQ ID NO: 469, SEQ ID NO: 470, SEQ ID NO: 472, SEQ ID NO: 473, SEQ ID NO: 474, SEQ ID NO: 475, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 485, SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 494 or SEQ ID NO: 495 or variant thereof does not compete with binding sites for Cry proteins in such insects.

Methods for Increasing Plant Yield

Methods for increasing plant yield are provided. The methods comprise providing a plant or plant cell expressing a polynucleotide encoding the pesticidal polypeptide sequence disclosed herein and growing the plant or a seed thereof in a field infested with a pest against which the polypeptide has pesticidal activity. In some embodiments, the polypeptide has pesticidal activity against a Lepidopteran, Coleopteran, Dipteran, Hemipteran or nematode pest, and the field is infested with a Lepidopteran, Hemipteran, Coleopteran, Dipteran or nematode pest.

As defined herein, the "yield" of the plant refers to the quality and/or quantity of biomass produced by the plant. "Biomass" as used herein refers to any measured plant product. An increase in biomass production is any improvement in the yield of the measured plant product. Increasing plant yield has several commercial applications. For example, increasing plant leaf biomass may increase the yield of leafy vegetables for human or animal consumption. Additionally, increasing leaf biomass can be used to increase production of plant-derived pharmaceutical or industrial products. An increase in yield can comprise any statistically significant increase including, but not limited to, at least a 1% increase, at least a 3% increase, at least a 5% increase, at least a 10% increase, at least a 20% increase, at least a 30%, at least a 50%, at least a 70%, at least a 100% or a greater increase in yield compared to a plant not expressing the pesticidal sequence.

In specific methods, plant yield is increased as a result of improved pest resistance of a plant expressing an IPD113 polypeptide disclosed herein. Expression of the IPD113 polypeptide results in a reduced ability of a pest to infest or feed on the plant, thus improving plant yield.

Methods of Processing

Further provided are methods of processing a plant, plant part or seed to obtain a food or feed product from a plant, plant part or seed comprising an IPD113 polynucleotide. The plants, plant parts or seeds provided herein, can be processed to yield oil, protein products and/or by-products that are derivatives obtained by processing that have commercial value. Non-limiting examples include transgenic seeds comprising a nucleic acid molecule encoding an IPD113 polypeptide which can be processed to yield soy oil, soy products and/or soy by-products.

"Processing" refers to any physical and chemical methods used to obtain any soy product and includes, but is not limited to, heat conditioning, flaking and grinding, extrusion, solvent extraction or aqueous soaking and extraction of whole or partial seeds The following examples are offered by way of illustration and not by way of limitation.

EXAMPLES

Example 1—Isolation and Identification of an Insecticidal Protein Active Against Lepidoptera Species from the Fern, *Pteris cretica*

Insecticidal activity against soybean looper ((SBL) (*Pseudoplusia includens*)) and corn earworm ((CEVV) (*Helicoverpa zea*)) was observed from a clarified and desalted extraction from *Pteris cretica* cv *albolineata* (PS930) and *Pteris umbrosa* (PS995) plant tissue. This insecticidal activity exhibited heat and protease sensitivity indicating proteinaceous nature. *Pteris cretica* cv *albolineata* (PS930) and *Pteris umbrosa* (PS995) had similar activity profiles from crude sample and anion exchange separated fractions and similar SDS-PAGE protein profiles at the crude level. Due to the limited amount of material the samples were combined into one sample for the purification steps.

The PS930 and PS995 combined plant material was removed from storage at −80° C. and ground to a fine powder at liquid Nitrogen temperatures with a Geno/Grinder® 2010 Ball Mill (SPEX Sample Prep®, Metuchen, N.J.). The protein was extracted from the plant tissue by adding extraction buffer ((50 mM Tris, pH 8.0, 150 mM Potassium Chloride, 2.5 mM EDTA, 1.5% Polyvinylpolypyrrolidone and Complete EDTA Free protease inhibitor tablets (Roche Diagnostics, Germany)) at a ratio of four mL per every one gram of fresh weight of tissue. The sample was kept in suspension by light agitation on a platform rocker at 4° C. for 15 minutes. The homogenate was clarified by centrifugation at 6000×g for 15 minutes followed by filtration through a Whatman 0.45 µm filter (GE Healthcare, Piscataway, N.J.). PS930 and PS995 were desalted into 50 mM Tris, pH 8.0 using 10 mL Zeba™ Spin desalting columns (Thermo Scientific, IL) before loading onto a 5 mL HiTrap™ Q-FF column (GE Healthcare, Piscataway, N.J.)

that was equilibrated in the same buffer. A linear 30 column volume gradient from 0.0 M to 0.7 M NaCl in 50 mM Tris, pH 8.0 was used to elute bound protein. The eluted fractions and flow-through were assayed against SBL as described in Example 6. Activity against SBL was detected in fractions eluting at approximately 13.0-31.0 mS/cm². The fractions were pooled and concentrated 10× on a 3 kDa MWCO filter (Pall Life Sciences, Port Washington, N.Y.) and loaded onto a HiPrep™ 16/60 Superdex 300 size exclusion column (GE Healthcare, Piscataway, N.J.). An isocratic gradient of 50 mM Tris, pH 8.0 was applied and the eluted 1 mL fractions were assayed against SBL and CEW. The active fractions were combined and injected onto a 5 mL Mono Q® 5/50 column (GE Healthcare, Piscataway, N.J.) equilibrated in 50 mM Tris, pH 8.0. A 65-column volume linear gradient from 0% to 60% Elution Buffer (50 mM Tris pH 8.0, 1.0 M NaCl) was performed to generate 0.5 mL fractions of eluted protein. The eluted proteins were bioassayed as previously described and SBL and CEW activity was detected in fractions eluting at ~7.5-12.7 mS/cm² conductivity. The active fractions were concentrated individually 10× and run on a LDS-PAGE and individual bands were excised for in gel digest.

Proteins for MS identification were obtained after running the sample on an LDS-PAGE gel stained with Coomassie™ Brilliant Blue G-250 stain. The bands of interest were excised from the gel, de-stained, reduced with dithiothreitol and then alkylated with iodoacetamide. Following overnight digestion with trypsin, liquid chromatography-tandem mass spectrometry (LC-MSMS) analysis for tryptically-digested peptides was conducted using electrospray ion source on a QToF Premiere™ mass spectrometer (Waters®, Milford, Mass.) coupled with a NanoAcquity™ nano-LC system (Waters®, Milford, Mass.) with a gradient from 2% acetonitrile, 0.1% formic acid to 60% acetonitrile, 0.1% formic acid.

Protein identification was performed by database searches using Mascot® (Matrix Science, 10 Perrins Lane, London NW3 1QY UK). The searches were conducted against an in-house transcriptome database containing transcripts from the *Pteris cretica* cv *albolineata* (PS930), *Pteris umbrosa* (PS995) and other source plants and the public protein database Swiss-Prot using the Mascot search engine (Matrix Science). Protein identification was also performed by taking the resulting LCMS data which was analyzed using ProteinLynx Global Server™ (Waters®, Milford, Mass.) to generate DeNovo sequence data. The amino acid sequences were BLAST™ (Basic Local Alignment Search Tool; Altschul, et al., (1993) *J. Mol. Biol.* 215:403-410; see also ncbi.nlm.nih.gov/BLAST/, which can be accessed using the www prefix) searched against public and DUPONT-PIONEER internal databases that included plant protein sequences. Amino acid sequences were aligned with proteins in a proprietary DUPONT-PIONEER plant protein database. Amino acid sequence from a band of interest aligned with predicted protein from PS930.

Example 2—Transcriptomic Sequencing of *Pteris cretica* cv *albolineata* and Cloning of IPD113Aa A transcriptome for *Pteris albolineata* syn *Pteris cretica* cv *albolineata*, (ID #PS930) was prepared as follows. Total RNAs were isolated from frozen tissues by use of the Qiagen® RNeasy® kit for total RNA isolation. Sequencing libraries from the resulting total RNAs were prepared using the TruSeq™ mRNA-Seq kit and protocol from Illumina®, Inc. (San Diego, Calif.). Briefly, mRNAs were isolated via attachment to oligo(dT) beads, fragmented to a mean size of 180 nt, reverse transcribed into cDNA by random hexamer prime, end repaired, 3' A-tailed, and ligated with Illumina® indexed TruSeq™ adapters. Ligated cDNA fragments were PCR amplified using Illumina® TruSeq™ primers and purified PCR products were checked for quality and quantity on the Agilent Bioanalyzer® DNA 7500 chip. Post quality and quantity assessment, 100 ng of the transcript library was normalized by treatment with Duplex-Specific Nuclease (DSN) (Evrogen®, Moscow, Russia). Normalization was accomplished by addition of 200 mM HEPES buffer, followed by heat denaturation and five hour anneal at 68° C. Annealed library was treated with 2 ul of DSN enzyme for 25 minutes, purified by Qiagen® MinElute® columns according to manufacturer protocols, and amplified twelve cycles using Illumina® adapter specific primers. Final products were purified with Ampure® XP beads (Beckman Genomics, Danvers, Mass.) and checked for quality and quantity on the Agilent Bioanalyzer® DNA 7500 chip.

Normalized transcript libraries were sequenced according to manufacturer protocols on the Illumina® Genome Analyzer IIx. Each library was hybridized to two flowcell lanes and amplified, blocked, linearized and primer hybridized using the Illumina clonal cluster generation process on cBot®. Sequencing was completed on the Genome Analyzer IIx, generating sixty million 75 bp paired end reads per normalized library.

Peptide sequences identified for IPD113Aa (SEQ ID NO: 1) by LCMS sequencing (described in Example 1) were searched against protein sequences predicted by open reading frames (ORFs) from the transcriptome assemblies for PS930. The peptides matched a transcript corresponding to IPD113Aa (SEQ ID NO: 1). The coding sequence was used to design the following primers: cgaaatctctcatctaagaggctg-gatcctaggATGGATTCCGATCTGATTGCTCAG (SEQ ID NO: 332) and gttggccaatccagaagatggacaagtctagaTCATGAT-GAGGGATCTTCAGGTG (SEQ ID NO: 333) to clone the IPD113Aa polynucleotide sequence (SEQ ID NO: 127) into a transient expression vector for expression and activity analysis.

Example 3—Expression and Insect Bioassay of IPD113Aa on Transient Leaf Tissues

To confirm activity of the IPD113Aa polypeptide (SEQ ID NO: 1) the corresponding gene (SEQ ID NO: 127) was cloned into a transient expression system under control of the viral promoter dMMV (Dey, et. al., (1999) *Plant Mol. Biol.* 40:771-782). The *Agrobacterium* strains containing the IPD113Aa expression construct was infiltrated into leaves. The agro-infiltration method of introducing an *Agrobacterium* cell suspension to plant cells of intact tissues so that reproducible infection and subsequent plant derived transgene expression may be measured or studied is well known in the art (Kapila, et. al., (1997) *Plant Science* 122:101-108). Briefly, the unifoliate leaves of bush bean (common bean, *Phaseolus vulgaris*) were agro-infiltrated with normalized bacterial cell cultures of test and control strains. Leaf discs were excised from each plantlet and infested with 2 neonates of Soy Bean Looper (SBL) (*Pseudoplusia includes*), 2 neonates of Fall Armyworm (FAVV) (*Spodoptera frugiperda*), 1 neonate of Corn Earworm (CEVV) (*Helicoverpa zea*), 3 neonates of Velvet Bean Caterpillar (VBC) (*Anticarsia gemmatalis*) or 3 neonates of European Corn Borer (ECB) (*Ostrinia* nubialis). Leaf discs from a control were generated with *Agrobacterium* not containing an expression vector. Leaf discs from a non-infiltrated plant were used as a second control. The consumption of the leaf tissue was scored three days after infestation (Table 1) and given scores of 0 to 9 as indicated by Table 2.

TABLE 1

| | SBL | | FAW | | CEW | | ECB | | VBC | |
|---|---|---|---|---|---|---|---|---|---|---|
| | Avg Score | Std. DEV | Avg Score | Std. DEV | Avg Score | Std. DEV | Avg Score | Std. DEV | Avg Score | Std. DEV |
| IPD113Aa | 7.8 | 0.5 | 4.0 | 1.4 | 4.8 | 1.3 | 8.0 | 0.8 | 7.8 | 0.5 |
| Empty Agro | 1.3 | 0.5 | 1.0 | 0.0 | 1.3 | 0.5 | 1.3 | 0.5 | 1.0 | 0.0 |
| Untreated | 2.5 | 3.0 | 1.0 | 0.0 | 2.3 | 2.5 | 3.3 | 1.9 | 1.0 | 0.0 |

TABLE 2

| Score | % Consumed |
|---|---|
| 1 | 86-100 |
| 2 | 71-85 |
| 3 | 61-70 |
| 4 | 51-60 |
| 5 | 36-50 |
| 6 | 11-35 |
| 7 | 4-10 |
| 8 | 1-3 |
| 9 | 0 |

Example 4—Identification of IPD113Aa Homologs

Gene identities may be determined by conducting BLAST™ (Basic Local Alignment Search Tool; Altschul, et al., (1993) *J. Mol. Biol.* 215:403-410; see also ncbi.nlm.nih-.gov/BLAST/, which can be accessed using the www prefix) searches under default parameters for similarity to sequences. The polynucleotide sequence for IPD113Aa (SEQ ID NO: 1) was analyzed. Gene identities conducted by BLAST™ in a DUPONT PIONEER internal plant transcriptomes database identified multiple homologs of IPD113Aa protein (SEQ ID NO: 1). The IPD113Aa homologs and the organism they were identified from are shown in Table 3.

TABLE 3

| Gene Name | Source | Organism | DNA Seq | AA Seq |
|---|---|---|---|---|
| IPD113Aa | PS930 | Pteris albolineata syn Pteris cretica cv albolineata | SEQ ID NO: 127 | SEQ ID NO: 1 |
| IPD113Ab | PS930 | Pteris albolineata syn Pteris cretica cv albolineata | SEQ ID NO: 128 | SEQ ID NO: 2 |
| IPD113Ac | PS930 | Pteris albolineata syn Pteris cretica cv albolineata | SEQ ID NO: 129 | SEQ ID NO: 3 |
| IPD113Ad | PS930 | Pteris albolineata syn Pteris cretica cv albolineata | SEQ ID NO: 130 | SEQ ID NO: 4 |
| IPD113Ae | PS995 | Pteris umbrosa | SEQ ID NO: 131 | SEQ ID NO: 5 |
| IPD113Ba | PS12357 | Polypodium formosanum 'Cristatum' | SEQ ID NO: 132 | SEQ ID NO: 6 |
| IPD113Bb | PS12357 | Polypodium formosanum 'Cristatum' | SEQ ID NO: 133 | SEQ ID NO: 7 |
| IPD113Bc | PS12357 | Polypodium formosanum 'Cristatum' | SEQ ID NO: 134 | SEQ ID NO: 8 |
| IPD113Da | PS8824 | Nephrolepis obliterata 'Kimberly Queen' | SEQ ID NO: 135 | SEQ ID NO: 9 |
| IPD113Db | PS7897 | Colysis wrightii (Hook.) Ching | SEQ ID NO: 136 | SEQ ID NO: 10 |
| IPD113Dc | PS8847 | Nephrolepis exaltata 'Compacta' | SEQ ID NO: 137 | SEQ ID NO: 11 |
| IPD113Dd | PS12356 | Davallia tyermannii (orig: Humata tyermannii) | SEQ ID NO: 138 | SEQ ID NO: 12 |
| IPD113De | PS14958 | Pyrrosia lanceolata | SEQ ID NO: 139 | SEQ ID NO: 13 |
| IPD113Df | PS14958 | Pyrrosia lanceolata | SEQ ID NO: 140 | SEQ ID NO: 14 |
| IPD113Dg | PS14958 | Pyrrosia lanceolata | SEQ ID NO: 141 | SEQ ID NO: 15 |
| IPD113Dh | PS9539 | Tectaria milnei | SEQ ID NO: 142 | SEQ ID NO: 16 |
| IPD113Di | PS2138 | Polystichum proliferum | SEQ ID NO: 143 | SEQ ID NO: 17 |
| IPD113Dj | PS2138 | Polystichum proliferum | SEQ ID NO: 144 | SEQ ID NO: 18 |
| IPD113Dk | PS2138 | Polystichum proliferum | SEQ ID NO: 145 | SEQ ID NO: 19 |
| IPD113Dl | PS13705 | Polystichum acrostichoides | SEQ ID NO: 146 | SEQ ID NO: 20 |
| IPD113Dm | PS845 | Pyrrosia rupestris | SEQ ID NO: 147 | SEQ ID NO: 21 |
| IPD113Dn | PS845 | Pyrrosia rupestris | SEQ ID NO: 148 | SEQ ID NO: 22 |
| IPD113Do | PS9163 | Asplenium antiquum Makino | SEQ ID NO: 149 | SEQ ID NO: 23 |
| IPD113Dp | NY28 | Doryopteris cordata | SEQ ID NO: 150 | SEQ ID NO: 24 |
| IPD113Dq | NY26 | Asplenium ebenoides | SEQ ID NO: 151 | SEQ ID NO: 25 |
| IPD113Dr | NY26 | Asplenium ebenoides | SEQ ID NO: 152 | SEQ ID NO: 26 |
| IPD113Ds | NY100 | Adiantum venustum | SEQ ID NO: 153 | SEQ ID NO: 27 |
| IPD113Ds (M18 Start) | NY100 | Adiantum venustum | SEQ ID NO: 154 | SEQ ID NO: 28 |
| IPD113Dt | NY75 | Arachniodes standishii | SEQ ID NO: 155 | SEQ ID NO: 29 |
| IPD113Du | NY100 | Adiantum venustum | SEQ ID NO: 156 | SEQ ID NO: 30 |
| IPD113Ea | NY007 | Blechnum medium (originally Doodia media) | SEQ ID NO: 157 | SEQ ID NO: 31 |
| IPD113Eb | PS12888 | Dryopteris intermedia | SEQ ID NO: 158 | SEQ ID NO: 32 |
| IPD113Ec | PS12888 | Dryopteris intermedia | SEQ ID NO: 159 | SEQ ID NO: 33 |
| IPD113Ed | PS12888 | Dryopteris intermedia | SEQ ID NO: 160 | SEQ ID NO: 34 |
| IPD113Ee | PS9145 | Ophioglossum pendulum | SEQ ID NO: 161 | SEQ ID NO: 35 |
| IPD113Ef | PS9145 | Ophioglossum pendulum | SEQ ID NO: 162 | SEQ ID NO: 36 |
| IPD113Eg | PS9145 | Ophioglossum pendulum | SEQ ID NO: 163 | SEQ ID NO: 37 |
| IPD113Eh | PS14994 | Pellaea falcata | SEQ ID NO: 164 | SEQ ID NO: 38 |
| IPD113Ei | PS989 | Adiantum aethiopicum | SEQ ID NO: 165 | SEQ ID NO: 39 |
| IPD113Ej | PS989 | Adiantum aethiopicum | SEQ ID NO: 166 | SEQ ID NO: 40 |
| IPD113Fa | PS9224 | Lygodium flexuosum | SEQ ID NO: 167 | SEQ ID NO: 41 |
| IPD113Fb | PS9224 | Lygodium flexuosum | SEQ ID NO: 168 | SEQ ID NO: 42 |
| IPD113Fc | PS9224 | Lygodium flexuosum | SEQ ID NO: 169 | SEQ ID NO: 43 |
| IPD113Fd | PS9224 | Lygodium flexuosum | SEQ ID NO: 170 | SEQ ID NO: 44 |
| IPD113Fe | PS930 | Pteris albolineata syn Pteris cretica cv albolineata | SEQ ID NO: 171 | SEQ ID NO: 45 |
| IPD113Ff | PS930 | Pteris albolineata syn Pteris cretica cv albolineata | SEQ ID NO: 172 | SEQ ID NO: 46 |
| IPD113Fg | PS930 | Pteris albolineata syn Pteris cretica cv albolineata | SEQ ID NO: 173 | SEQ ID NO: 47 |

TABLE 3-continued

| Gene Name | Source | Organism | DNA Seq | AA Seq |
|---|---|---|---|---|
| IPD113Fh | PS930 | Pteris albolineata syn Pteris cretica cv albolineata | SEQ ID NO: 174 | SEQ ID NO: 48 |
| IPD113Fi | NY14 | Adiantum polyphyllum 'Amaretto' | SEQ ID NO: 175 | SEQ ID NO: 49 |
| IPD113Fj | NY14 | Adiantum polyphyllum 'Amaretto' | SEQ ID NO: 176 | SEQ ID NO: 50 |
| IPD113Fk | NY14 | Adiantum polyphyllum 'Amaretto' | SEQ ID NO: 177 | SEQ ID NO: 51 |
| IPD113Fl | PS8798 | Blechnum occidentale | SEQ ID NO: 178 | SEQ ID NO: 52 |
| IPD113Ga | NY007 | Blechnum medium (originally Doodia media) | SEQ ID NO: 179 | SEQ ID NO: 53 |
| IPD113Gb | NY54 | Gymnocarpium dryopteris | SEQ ID NO: 180 | SEQ ID NO: 54 |
| IPD113Gc | NY54 | Gymnocarpium dryopteris | SEQ ID NO: 181 | SEQ ID NO: 55 |
| IPD113Gd | NY54 | Gymnocarpium dryopteris | SEQ ID NO: 182 | SEQ ID NO: 56 |
| IPD113Ge | NY54 | Gymnocarpium dryopteris | SEQ ID NO: 183 | SEQ ID NO: 57 |
| IPD113Gf | PS13705 | Polystichum acrostichoides | SEQ ID NO: 184 | SEQ ID NO: 58 |
| IPD113Gg | PS13705 | Polystichum acrostichoides | SEQ ID NO: 185 | SEQ ID NO: 59 |
| IPD113Gh | PS13705 | Polystichum acrostichoides | SEQ ID NO: 186 | SEQ ID NO: 60 |
| IPD113Gi | PS898 | Cheilanthes sieberi | SEQ ID NO: 187 | SEQ ID NO: 61 |
| IPD113Dv | PS3637 | Polypodium vulgare | SEQ ID NO: 188 | SEQ ID NO: 62 |
| IPD113Ek | PS3640 | Adiantum hispidulum var. whtei | SEQ ID NO: 189 | SEQ ID NO: 63 |
| IPD113El | PS3640 | Adiantum hispidulum var. whtei | SEQ ID NO: 190 | SEQ ID NO: 64 |
| IPD113Em | PS5307 | Colysis ampla | SEQ ID NO: 191 | SEQ ID NO: 65 |
| IPD113En | PS5307 | Colysis ampla | SEQ ID NO: 192 | SEQ ID NO: 66 |
| IPD113Eo | PS826 | Adiantum formosum | SEQ ID NO: 193 | SEQ ID NO: 67 |
| IPD113Ep | PS826 | Adiantum formosum | SEQ ID NO: 194 | SEQ ID NO: 68 |
| IPD113Eq | PS826 | Adiantum formosum | SEQ ID NO: 195 | SEQ ID NO: 69 |
| IPD113Dw | PS843 | Polypodium billardieri | SEQ ID NO: 196 | SEQ ID NO: 70 |
| IPD113Dx | PS11034 | Polystichum braunii | SEQ ID NO: 197 | SEQ ID NO: 71 |
| IPD113Dy | PS9433 | Lygodium japonicum | SEQ ID NO: 198 | SEQ ID NO: 72 |
| IPD113Dz | PS9433 | Lygodium japonicum | SEQ ID NO: 199 | SEQ ID NO: 73 |
| IPD113Daa | PS9433 | Lygodium japonicum | SEQ ID NO: 200 | SEQ ID NO: 74 |
| IPD113Dab | NY30 | Dryopteris lepidopoda | SEQ ID NO: 201 | SEQ ID NO: 75 |
| IPD113Er | PS2220 | Pteridium esculentum | SEQ ID NO: 202 | SEQ ID NO: 76 |
| IPD113Es | PS3642 | Pellaea falcata var. nana | SEQ ID NO: 203 | SEQ ID NO: 77 |
| IPD113Gj | PS3642 | Pellaea falcata var. nana | SEQ ID NO: 204 | SEQ ID NO: 78 |
| IPD113Fm | PS4722 | Christella dentata | SEQ ID NO: 205 | SEQ ID NO: 79 |
| IPD113Fn | PS4722 | Christella dentata | SEQ ID NO: 206 | SEQ ID NO: 80 |
| IPD113Fo | PS4722 | Christella dentata | SEQ ID NO: 207 | SEQ ID NO: 81 |
| IPD113Dac | PS5237 | Lastreopsis tinarooensis | SEQ ID NO: 208 | SEQ ID NO: 82 |
| IPD113Dad | PS5237 | Lastreopsis tinarooensis | SEQ ID NO: 209 | SEQ ID NO: 83 |
| IPD113Fp | PS5239 | Asplenium boltonii | SEQ ID NO: 210 | SEQ ID NO: 84 |
| IPD113Fq | PS5239 | Asplenium boltonii | SEQ ID NO: 211 | SEQ ID NO: 85 |
| IPD113Fr | PS5256 | Campyloneurum xalapense | SEQ ID NO: 212 | SEQ ID NO: 86 |
| IPD113Fs | PS5256 | Campyloneurum xalapense | SEQ ID NO: 213 | SEQ ID NO: 87 |
| IPD113Dae | PS5307 | Colysis ampla | SEQ ID NO: 214 | SEQ ID NO: 88 |
| IPD113Daf | PS5307 | Colysis ampla | SEQ ID NO: 215 | SEQ ID NO: 89 |
| IPD113Dag | PS5307 | Colysis ampla | SEQ ID NO: 216 | SEQ ID NO: 90 |
| IPD113Dah | PS5307 | Colysis ampla | SEQ ID NO: 217 | SEQ ID NO: 91 |
| IPD113Et | PS9169 | Asplenium dimorphum x difforme | SEQ ID NO: 218 | SEQ ID NO: 92 |
| IPD113Eu | NY28 | Doryopteris cordata | SEQ ID NO: 219 | SEQ ID NO: 93 |
| IPD113Ev | NY28 | Doryopteris cordata | SEQ ID NO: 220 | SEQ ID NO: 94 |
| IPD113Ew | NY28 | Doryopteris cordata | SEQ ID NO: 221 | SEQ ID NO: 95 |
| IPD113Ex | NY28 | Doryopteris cordata | SEQ ID NO: 222 | SEQ ID NO: 96 |
| IPD113Dai | PS13456 | Nephrolepis exaltata | SEQ ID NO: 223 | SEQ ID NO: 97 |
| IPD113Daj | PS13456 | Nephrolepis exaltata | SEQ ID NO: 224 | SEQ ID NO: 98 |
| IPD113Dc_M28 | PS12360 | Nephrolepis exaltata 'Tiger Fern' | SEQ ID NO: 225 | SEQ ID NO: 99 |
| IPD113Dak | PS12360 | Nephrolepis exaltata 'Tiger Fern' | SEQ ID NO: 226 | SEQ ID NO: 100 |
| IPD113Dal | PS12360 | Nephrolepis exaltata 'Tiger Fern' | SEQ ID NO: 227 | SEQ ID NO: 101 |
| IPD113Dam | PS12360 | Nephrolepis exaltata 'Tiger Fern' | SEQ ID NO: 228 | SEQ ID NO: 102 |
| IPD113Ey | NY25 | Hemionitis arifolia | SEQ ID NO: 229 | SEQ ID NO: 103 |
| IPD113Ez | NY25 | Hemionitis arifolia | SEQ ID NO: 230 | SEQ ID NO: 104 |
| IPD113Eaa | NY25 | Hemionitis arifolia | SEQ ID NO: 231 | SEQ ID NO: 105 |
| IPD113Eab | NY25 | Hemionitis arifolia | SEQ ID NO: 232 | SEQ ID NO: 106 |
| IPD113Eac | NY25 | Hemionitis arifolia | SEQ ID NO: 233 | SEQ ID NO: 107 |
| IPD113Ft | PS2140 | Pteridium esculentum | SEQ ID NO: 234 | SEQ ID NO: 108 |
| IPD113Fv | PS2140 | Pteridium esculentum | SEQ ID NO: 235 | SEQ ID NO: 109 |
| IPD113Ead | PS14994 | Pellaea falcata | SEQ ID NO: 236 | SEQ ID NO: 110 |
| IPD113Dan | PS14994 | Pellaea falcata | SEQ ID NO: 237 | SEQ ID NO: 111 |
| IPD113Dao | PS14994 | Pellaea falcata | SEQ ID NO: 238 | SEQ ID NO: 112 |
| IPD113Dap | PS022 | Ophioglossum pendulum (Medium) | SEQ ID NO: 239 | SEQ ID NO: 113 |
| IPD113Daq | PS022 | Ophioglossum pendulum (Medium) | SEQ ID NO: 240 | SEQ ID NO: 114 |
| IPD113Gk | PS5338 | Selliguea feei | SEQ ID NO: 241 | SEQ ID NO: 115 |
| IPD113Gl | PS5338 | Selliguea feei | SEQ ID NO: 242 | SEQ ID NO: 116 |
| IPD113Gm | PS5338 | Selliguea feei | SEQ ID NO: 243 | SEQ ID NO: 117 |
| IPD113Gn | PS5338 | Selliguea feei | SEQ ID NO: 244 | SEQ ID NO: 118 |
| IPD113Go | PS5338 | Selliguea feei | SEQ ID NO: 245 | SEQ ID NO: 119 |
| IPD113Eai | NY165 | Polypodium glycyrrhiza | SEQ ID NO: 246 | SEQ ID NO: 120 |
| IPD113Eae | PS5360 | Tectaria antioquoiana | SEQ ID NO: 247 | SEQ ID NO: 121 |
| IPD113Eah | PS5360 | Tectaria antioquoiana | SEQ ID NO: 248 | SEQ ID NO: 122 |
| IPD113Eaf | PS5360 | Tectaria antioquoiana | SEQ ID NO: 249 | SEQ ID NO: 123 |
| IPD113Eag | PS5360 | Tectaria antioquoiana | SEQ ID NO: 250 | SEQ ID NO: 124 |
| IPD113Fx | PS11699 | Nephrolepis cordifolia (Duffii) | SEQ ID NO: 251 | SEQ ID NO: 125 |

TABLE 3-continued

| Gene Name | Source | Organism | DNA Seq | AA Seq |
|---|---|---|---|---|
| IPD113Fw | PS11699 | Nephrolepis cordifolia (Duffii) | SEQ ID NO: 252 | SEQ ID NO: 126 |
| IPD113Ca | PS6040 | Asplenium pellucidum | SEQ ID NO: 335 | SEQ ID NO: 416 |
| IPD113Cb | PS6069 | Asplenium laserpitiifolium | SEQ ID NO: 336 | SEQ ID NO: 417 |
| IPD113Be | PS6069 | Asplenium laserpitiifolium | SEQ ID NO: 337 | SEQ ID NO: 418 |
| IPD113Bd | PS6069 | Asplenium laserpitiifolium | SEQ ID NO: 338 | SEQ ID NO: 419 |
| IPD113Bf | PS6069 | Asplenium laserpitiifolium | SEQ ID NO: 339 | SEQ ID NO: 420 |
| IPD113Eaj | PS6087 | Hymenasplenium unilaterale | SEQ ID NO: 340 | SEQ ID NO: 421 |
| IPD113Dav | PS5404 | Pellaea ovata | SEQ ID NO: 341 | SEQ ID NO: 422 |
| IPD113Daw | PS5404 | Pellaea ovata | SEQ ID NO: 342 | SEQ ID NO: 423 |
| IPD113Dax | PS5404 | Pellaea ovata | SEQ ID NO: 343 | SEQ ID NO: 424 |
| IPD113Day | PS5404 | Pellaea ovata | SEQ ID NO: 344 | SEQ ID NO: 425 |
| IPD113Daz | PS5404 | Pellaea ovata | SEQ ID NO: 345 | SEQ ID NO: 426 |
| IPD113Dba | PS5404 | Pellaea ovata | SEQ ID NO: 346 | SEQ ID NO: 427 |
| IPD113Dar | PS5404 | Pellaea ovata | SEQ ID NO: 347 | SEQ ID NO: 428 |
| IPD113Das | PS5404 | Pellaea ovata | SEQ ID NO: 348 | SEQ ID NO: 429 |
| IPD113Dat | PS5404 | Pellaea ovata | SEQ ID NO: 349 | SEQ ID NO: 430 |
| IPD113Dau | PS5404 | Pellaea ovata | SEQ ID NO: 350 | SEQ ID NO: 431 |
| IPD113Dbb | PS5405 | Myriopteris myriophylla | SEQ ID NO: 351 | SEQ ID NO: 432 |
| IPD113Dbd | PS5405 | Myriopteris myriophylla | SEQ ID NO: 352 | SEQ ID NO: 433 |
| IPD113Dbe | PS5405 | Myriopteris myriophylla | SEQ ID NO: 353 | SEQ ID NO: 434 |
| IPD113Dbc | PS5405 | Myriopteris myriophylla | SEQ ID NO: 354 | SEQ ID NO: 435 |
| IPD113Fac | NY182 | Pyrrosia linearifolia | SEQ ID NO: 355 | SEQ ID NO: 436 |
| IPD113Fad | NY189 | Pyrrosia stigmosa | SEQ ID NO: 356 | SEQ ID NO: 437 |
| IPD113Fae | NY189 | Pyrrosia stigmosa | SEQ ID NO: 357 | SEQ ID NO: 438 |
| IPD113Eak | LW12339 | Polypodium attenuatum 'Falax' | SEQ ID NO: 358 | SEQ ID NO: 439 |
| IPD113Eal | LW12339 | Polypodium attenuatum 'Falax' | SEQ ID NO: 359 | SEQ ID NO: 440 |
| IPD113Eam | LW12339 | Polypodium attenuatum 'Falax' | SEQ ID NO: 360 | SEQ ID NO: 441 |
| IPD113Gp | LW9210 | Aglaomorpha 'Roberts' | SEQ ID NO: 361 | SEQ ID NO: 442 |
| IPD113Faa | LW9210 | Aglaomorpha 'Roberts' | SEQ ID NO: 362 | SEQ ID NO: 443 |
| IPD113Fab | LW9210 | Aglaomorpha 'Roberts' | SEQ ID NO: 363 | SEQ ID NO: 444 |
| IPD113Gq | LW9210 | Aglaomorpha 'Roberts' | SEQ ID NO: 364 | SEQ ID NO: 445 |
| IPD113Fy | LW9210 | Aglaomorpha 'Roberts' | SEQ ID NO: 365 | SEQ ID NO: 446 |
| IPD113Fz | LW9210 | Aglaomorpha 'Roberts' | SEQ ID NO: 366 | SEQ ID NO: 447 |
| IPD113Dbf | LW9539 | Tectaria milnei | SEQ ID NO: 367 | SEQ ID NO: 448 |
| IPD113Dbi | LW9539 | Tectaria milnei | SEQ ID NO: 368 | SEQ ID NO: 449 |
| IPD113Dbg | LW9539 | Tectaria milnei | SEQ ID NO: 369 | SEQ ID NO: 450 |
| IPD113Dbh | LW9539 | Tectaria milnei | SEQ ID NO: 370 | SEQ ID NO: 451 |
| IPD113Faf | NY28 | Doryopteris cordata | SEQ ID NO: 371 | SEQ ID NO: 452 |
| IPD113Fah | NY28 | Doryopteris cordata | SEQ ID NO: 372 | SEQ ID NO: 453 |
| IPD113Fai | NY28 | Doryopteris cordata | SEQ ID NO: 373 | SEQ ID NO: 454 |
| IPD113Faj | NY28 | Doryopteris cordata | SEQ ID NO: 374 | SEQ ID NO: 455 |
| IPD113Fak | NY28 | Doryopteris cordata | SEQ ID NO: 375 | SEQ ID NO: 456 |
| IPD113Fag | NY28 | Doryopteris cordata | SEQ ID NO: 376 | SEQ ID NO: 457 |
| IPD113Eas | PS935 | Asplenium flabellifolium | SEQ ID NO: 377 | SEQ ID NO: 458 |
| IPD113Eat | PS935 | Asplenium flabellifolium | SEQ ID NO: 378 | SEQ ID NO: 459 |
| IPD113Eau | PS5226 | Davallia pentaphylla | SEQ ID NO: 379 | SEQ ID NO: 460 |
| IPD113Eay | PS5226 | Davallia pentaphylla | SEQ ID NO: 380 | SEQ ID NO: 461 |
| IPD113Eav | PS5226 | Davallia pentaphylla | SEQ ID NO: 381 | SEQ ID NO: 462 |
| IPD113Eaw | PS5410 | Microsorum commutatum | SEQ ID NO: 382 | SEQ ID NO: 463 |
| IPD113Df_C_TR1 | PS5428 | Pyrrosia rupestris | SEQ ID NO: 383 | SEQ ID NO: 464 |
| IPD113Eap_C_TR1 | PS5428 | Pyrrosia rupestris | SEQ ID NO: 384 | SEQ ID NO: 465 |
| IPD113Eaq | PS5428 | Pyrrosia rupestris | SEQ ID NO: 385 | SEQ ID NO: 466 |
| IPD113Eao | PS5428 | Pyrrosia rupestris | SEQ ID NO: 386 | SEQ ID NO: 467 |
| IPD113Ean | PS5428 | Pyrrosia rupestris | SEQ ID NO: 387 | SEQ ID NO: 468 |
| IPD113Ear | PS5428 | Pyrrosia rupestris | SEQ ID NO: 388 | SEQ ID NO: 469 |
| IPD113Eap | PS5428 | Pyrrosia rupestris | SEQ ID NO: 389 | SEQ ID NO: 470 |
| IPD113Fal | PS5428 | Pyrrosia rupestris | SEQ ID NO: 390 | SEQ ID NO: 471 |
| IPD113Dbj | PS5431 | Arthropteris tenella | SEQ ID NO: 391 | SEQ ID NO: 472 |
| IPD113Dbk | PS6057 | Stenochlaena palustris | SEQ ID NO: 392 | SEQ ID NO: 473 |
| IPD113Dbl | PS6057 | Stenochlaena palustris | SEQ ID NO: 393 | SEQ ID NO: 474 |
| IPD113Fam | LW8833 | Elaphoglossum | SEQ ID NO: 394 | SEQ ID NO: 475 |
| IPD113Fan | LW8833 | Elaphoglossum | SEQ ID NO: 395 | SEQ ID NO: 476 |
| IPD113Fao | LW8833 | Elaphoglossum | SEQ ID NO: 396 | SEQ ID NO: 477 |
| IPD113Eax_N_TR1 | NY065 | Myriopteris lanosa 'Mighty Tidy' | SEQ ID NO: 397 | SEQ ID NO: 478 |
| IPD113Eax | NY065 | Myriopteris lanosa 'Mighty Tidy' | SEQ ID NO: 398 | SEQ ID NO: 479 |
| IPD113Eaz | NY177 | Drynaria sparsisora | SEQ ID NO: 399 | SEQ ID NO: 480 |
| IPD113Eba | NY177 | Drynaria sparsisora | SEQ ID NO: 400 | SEQ ID NO: 481 |
| IPD113Ebc | LW12274 | Thelypteris noveboracensis | SEQ ID NO: 401 | SEQ ID NO: 482 |
| IPD113Ebd | LW12274 | Thelypteris noveboracensis | SEQ ID NO: 402 | SEQ ID NO: 483 |
| IPD113Ebf | LW12274 | Thelypteris noveboracensis | SEQ ID NO: 403 | SEQ ID NO: 484 |
| IPD113Ebe | LW12274 | Thelypteris noveboracensis | SEQ ID NO: 404 | SEQ ID NO: 485 |
| IPD113Ebb | LW12349 | Pteris ensiformis 'Evergemiensis' | SEQ ID NO: 405 | SEQ ID NO: 486 |
| IPD113Dbm | LW12415 | Polystichum tripteron | SEQ ID NO: 406 | SEQ ID NO: 487 |
| IPD113Cc | PS8002 | Asplenium athertonense | SEQ ID NO: 407 | SEQ ID NO: 488 |
| IPD113Ebg | PS6088 | Lindsaea brachypoda | SEQ ID NO: 408 | SEQ ID NO: 489 |
| IPD113Ebk | PS989 | Adiantum aethiopicum | SEQ ID NO: 409 | SEQ ID NO: 490 |
| IPD113Ebj | PS989 | Adiantum aethiopicum | SEQ ID NO: 410 | SEQ ID NO: 491 |
| IPD113Far | NY138 | Tectaria cicutaria 'button ball fern' | SEQ ID NO: 411 | SEQ ID NO: 492 |

TABLE 3-continued

| Gene Name | Source | Organism | DNA Seq | AA Seq |
|---|---|---|---|---|
| IPD113Faq | NY138 | *Tectaria cicutaria* 'button ball fern' | SEQ ID NO: 412 | SEQ ID NO: 493 |
| IPD113Fap | NY138 | *Tectaria cicutaria* 'button ball fern' | SEQ ID NO: 413 | SEQ ID NO: 494 |
| IPD113Ebh | NY246 | *Dryopteris hondoensis* | SEQ ID NO: 414 | SEQ ID NO: 495 |
| IPD113Ebi | NY246 | *Dryopteris hondoensis* | SEQ ID NO: 415 | SEQ ID NO: 496 | cDNA was generated from source organisms with identified homologs from the internal database by reverse transcription from total RNA. Homologs were PCR amplified from their respective cDNAs using primers designed for the coding sequences of each homolog and subcloned into a plant transient vector containing the DMMV promoter. Cloned PCR products were confirmed by sequencing.

Figure 4A:
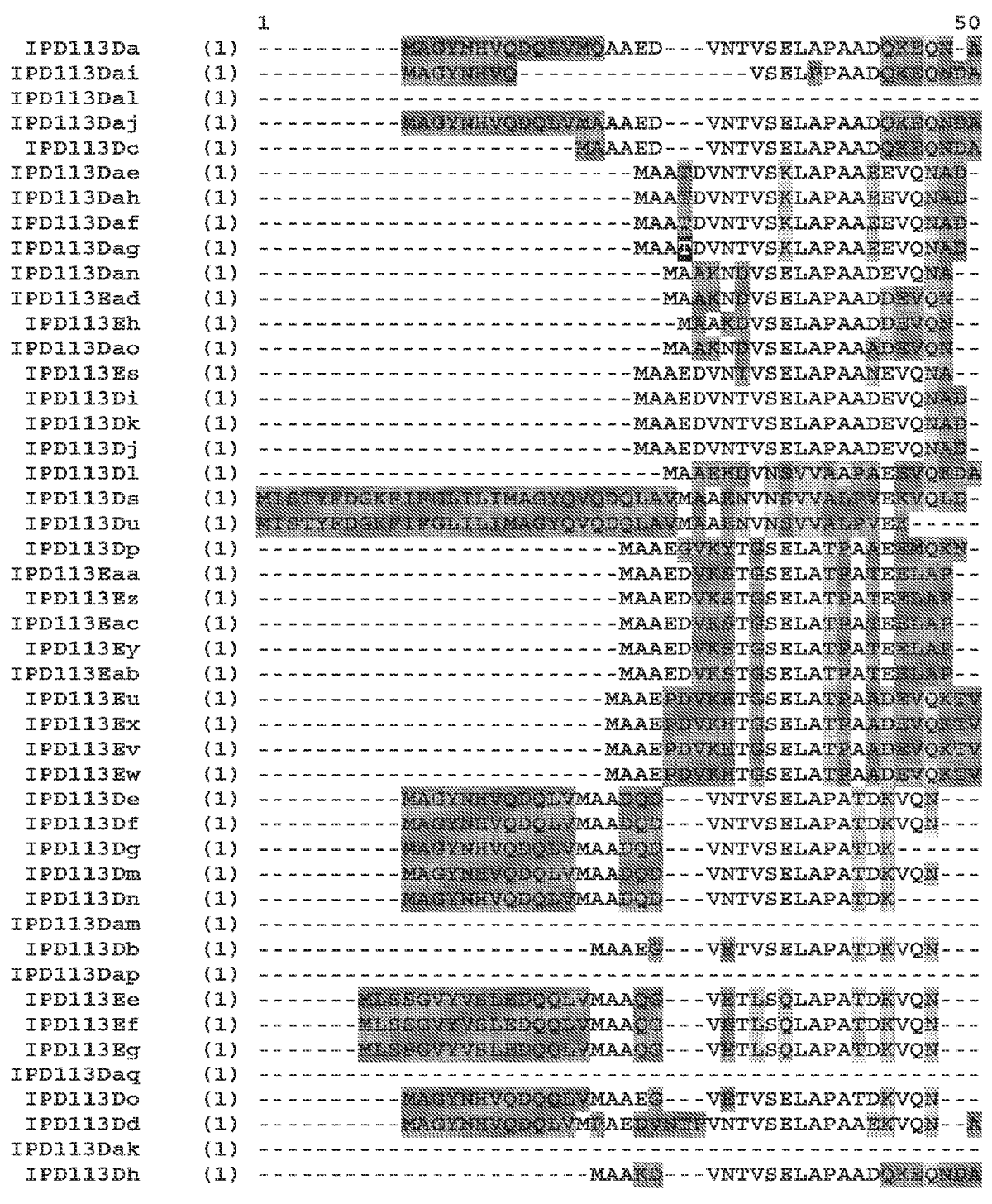

The amino acid sequence identity of the IPD113 homologs was calculated using the Needleman-Wunsch algorithm, as implemented in the Needle program (EMBOSS tool suite). The percent sequence identities of IPD113 homologs within a selected subgroup are shown in Table 4. The percent sequence identities of selected IPD113 homolog subgroups are shown in Table 5. In a likewise manner one skilled in the art can compare the percent identity of other groupings of IPD113 homologs. Phylogenic trees of selected subgroups of IPD113 homologs are shown in FIGS. 2, 3, and 4.

TABLE 4

|  | IPD113Ab | IPD113Ac | IPD113Ad | IPD113Ae | IPD113Ba | IPD113Bb | IPD113Bc |
|---|---|---|---|---|---|---|---|
| IPD113Aa SEQ ID NO: 1 | 96.0 | 92.4 | 91.7 | 95.2 | 81.8 | 88.2 | 88.2 |
| IPD113Ab SEQ ID NO: 2 | — | 94.9 | 95.6 | 93.4 | 80.7 | 86.9 | 86.9 |
| IPD113Ac SEQ ID NO: 3 | — | — | 99.2 | 91.4 | 82.0 | 87.9 | 87.9 |
| IPD113Ad SEQ ID NO: 4 | — | — | — | 91.1 | 81.6 | 87.5 | 87.5 |
| IPD113Ae SEQ ID NO: 5 | — | — | — | — | 82.0 | 87.9 | 87.9 |
| IPD113Ba SEQ ID NO: 6 | — | — | — | — | — | 92.8 | 92.6 |
| IPD113Bb SEQ ID NO: 7 | — | — | — | — | — | — | 99.8 |

TABLE 5

|  | IPD113Ab | IPD113Bb | IPD113Bc | IPD113Db | IPD113Dh | IPD113Ei | IPD113Ej | IPD113Fa | IPD113Fl | IPD113Gg | IPD113Gh |
|---|---|---|---|---|---|---|---|---|---|---|---|
| IPD113Aa SEQ ID NO: 1 | 96.0 | 88.2 | 88.2 | 60.6 | 63.1 | 57.0 | 56.4 | 50.6 | 49.3 | 32.4 | 35.0 |
| IPD113Ab SEQ ID NO: 2 | — | 86.9 | 86.9 | 59.9 | 62.6 | 56.9 | 56.3 | 49.1 | 49.2 | 32.2 | 34.8 |
| IPD113Bb SEQ ID NO: 7 | — | — | 99.8 | 60.4 | 61.4 | 54.5 | 54.0 | 50.4 | 48.5 | 32.3 | 34.6 |
| IPD113Bc SEQ ID NO: 8 | — | — | — | 60.4 | 61.4 | 54.5 | 54.0 | 50.4 | 48.5 | 32.3 | 34.6 |
| IPD113Db SEQ ID NO: 10 | — | — | — | — | 91.5 | 69.8 | 69.2 | 52.6 | 54.9 | 34.2 | 36.9 |
| IPD113Dh SEQ ID NO: 16 | — | — | — | — | — | 70.8 | 70.3 | 53.2 | 55.7 | 33.9 | 36.4 |
| IPD113Ei SEQ ID NO: 39 | — | — | — | — | — | — | 99.1 | 53.5 | 52.5 | 33.6 | 35.9 |
| IPD113Ej SEQ ID NO: 40 | — | — | — | — | — | — | — | 53.5 | 52.0 | 33.2 | 35.5 |
| IPD113Fa SEQ ID NO: 41 | — | — | — | — | — | — | — | — | 45.5 | 32.7 | 35.2 |
| IPD113Fl SEQ ID NO: 52 | — | — | — | — | — | — | — | — | — | 33.0 | 35.1 |
| IPD113Gg SEQ ID NO: 59 | — | — | — | — | — | — | — | — | — | — | 89.3 |

Example 5—*Agrobacterium*-Mediated Transient Expression of IPD113 Homologs in Bean Activity of IPD113 homologs was measured using a bush bean transient expression system as described in Example 3. The activity spectra for tested IPD113 homologs are summarized in Table 6, where a "++++" indicates an average activity score of <=10% of leaf disc consumed, a "+++" indicates an average activity score of 11-50% leaf disc consumed, a "++" indicates an average activity score of 51-70% leaf disc consumed, a '+' indicates an average activity score of >70% leaf disc consumed, and "ND" indicates not determined.

TABLE 6

|  |  | SBL | FAW | CEW | ECB | VBC |
|---|---|---|---|---|---|---|
| IPD113Aa | SEQ ID NO: 1 | ++++ | ++ | ++ | ++++ | ++++ |
| IPD113Ab | SEQ ID NO: 2 | +++ | + | ++ | + | ND |
| IPD113Ac | SEQ ID NO: 3 | + | + | +++ | + | ND |
| IPD113Ad | SEQ ID NO: 4 | ++ | + | + | + | ND |
| IPD113Ae | SEQ ID NO: 5 | + | + | + | + | ND |
| IPD113Ba | SEQ ID NO: 6 | + | + | + | + | ND |
| IPD113Bb | SEQ ID NO: 7 | +++ | + | +++ | ++ | +++ |
| IPD113Bc | SEQ ID NO: 8 | ++++ | + | +++ | ++ | +++ |
| IPD113Da | SEQ ID NO: 9 | ++++ | +++ | ++++ | +++ | ++++ |
| IPD113Db | SEQ ID NO: 10 | ++++ | ++++ | ++++ | +++ | ++++ |
| IPD113Dc | SEQ ID NO: 11 | ++++ | +++ | ++++ | +++ | ++++ |
| IPD113Dd | SEQ ID NO: 12 | ++++ | ++ | ++++ | ++++ | ++++ |
| IPD113De | SEQ ID NO: 13 | +++ | ++++ | + | ++ | ++++ |
| IPD113Df | SEQ ID NO: 14 | +++ | ++++ | + | ++ | ++++ |
| IPD113Dg | SEQ ID NO: 15 | +++ | ++++ | + | +++ | ++++ |
| IPD113Dh | SEQ ID NO: 16 | ++++ | ++++ | ++++ | ++++ | ++++ |
| IPD113Di | SEQ ID NO: 17 | ++++ | ++++ | +++ | +++ | ++++ |
| IPD113Dj | SEQ ID NO: 18 | ++++ | +++ | +++ | ++ | +++ |
| IPD113Dk | SEQ ID NO: 19 | ++++ | +++ | +++ | ++++ | ++++ |
| IPD113Dl | SEQ ID NO: 20 | ++ | ++ | +++ | ++ | ++++ |
| IPD113Dm | SEQ ID NO: 21 | ++++ | ++++ | + | +++ | ++++ |
| IPD113Dn | SEQ ID NO: 22 | ++++ | ++++ | ++ | ++++ | ++++ |
| IPD113Do | SEQ ID NO: 23 | ++ | +++ | + | ++ | ++ |
| IPD113Dp | SEQ ID NO: 24 | ++++ | ++++ | ++++ | +++ | ++++ |
| IPD113Dq | SEQ ID NO: 25 | ++ | +++ | +++ | +++ | ++++ |
| IPD113Dr | SEQ ID NO: 26 | + | ++++ | +++ | ++ | ++++ |
| IPD113Ds | SEQ ID NO: 27 | +++ | +++ | ++ | ++ | ++++ |
| IPD113Ds (M18 Start) | SEQ ID NO: 28 | ++++ | ++++ | +++ | +++ | ++++ |
| IPD113Dt | SEQ ID NO: 29 | + | + | + | + | + |
| IPD113Du | SEQ ID NO: 30 | +++ | ++ | ++ | +++ | ++++ |
| IPD113Ea | SEQ ID NO: 31 | ++ | + | + | + | ND |
| IPD113Eb | SEQ ID NO: 32 | + | + | + | + | ND |
| IPD113Ec | SEQ ID NO: 33 | + | + | ++ | + | ND |
| IPD113Ed | SEQ ID NO: 34 | ++++ | + | +++ | + | ++++ |
| IPD113Ee | SEQ ID NO: 35 | ++++ | +++ | ++++ | +++ | ++++ |
| IPD113Ef | SEQ ID NO: 36 | ++ | ++ | ++ | ++ | ++++ |
| IPD113Eg | SEQ ID NO: 37 | ++++ | ++ | ++++ | +++ | ++++ |
| IPD113Eh | SEQ ID NO: 38 | + | ++ | ++ | + | ++++ |
| IPD113Ei | SEQ ID NO: 39 | ++++ | ++++ | ++++ | ++++ | ++++ |
| IPD113Ej | SEQ ID NO: 40 | ++++ | ++++ | ++++ | +++ | ++++ |
| IPD113Fa | SEQ ID NO: 41 | ++++ | + | +++ | ++ | +++ |
| IPD113Fb | SEQ ID NO: 42 | + | + | + | + | + |
| IPD113Fc | SEQ ID NO: 43 | ++ | + | + | + | + |
| IPD113Fd | SEQ ID NO: 44 | + | + | + | ++ | + |
| IPD113Fe | SEQ ID NO: 45 | +++ | + | + | + | + |
| IPD113Ff | SEQ ID NO: 46 | ++ | + | ++ | +++ | + |
| IPD113Fg | SEQ ID NO: 47 | + | ++ | + | ++ | + |
| IPD113Fh | SEQ ID NO: 48 | + | +++ | + | + | + |
| IPD113Fi | SEQ ID NO: 49 | + | ++ | +++ | +++ | + |
| IPD113Fj | SEQ ID NO: 50 | + | ++ | + | ++ | ++ |
| IPD113Fk | SEQ ID NO: 51 | + | + | + | + | + |
| IPD113Fl | SEQ ID NO: 52 | + | ++++ | + | +++ | ++ |
| IPD113Ga | SEQ ID NO: 53 | + | + | + | + | ND |
| IPD113Gb | SEQ ID NO: 54 | + | ++ | + | + | + |
| IPD113Gc | SEQ ID NO: 55 | + | ++ | + | ++ | + |
| IPD113Gd | SEQ ID NO: 56 | + | + | + | +++ | + |
| IPD113Ge | SEQ ID NO: 57 | + | ++ | + | ++ | + |
| IPD113Gf | SEQ ID NO: 58 | + | ++ | + | +++ | + |
| IPD113Gg | SEQ ID NO: 59 | + | +++ | + | +++ | ++ |
| IPD113Gh | SEQ ID NO: 60 | ++ | ++ | ++ | +++ | ++ |
| IPD113Gi | SEQ ID NO: 61 | + | + | + | ++ | ++ |
| IPD113Dv | SEQ ID NO: 62 | +++ | ++ | +++ | +++ | ++++ |
| IPD113Ek | SEQ ID NO: 63 | + | + | + | + | ND |
| IPD113El | SEQ ID NO: 64 | + | + | + | +++ | ND |
| IPD113Em | SEQ ID NO: 65 | + | ++ | + | ++ | +++ |
| IPD113En | SEQ ID NO: 66 | + | ++ | + | +++ | ++ |
| IPD113Eo | SEQ ID NO: 67 | ++ | + | + | ++ | + |

TABLE 6-continued

| | | SBL | FAW | CEW | ECB | VBC |
|---|---|---|---|---|---|---|
| IPD113Ep | SEQ ID NO: 68 | ++ | + | +++ | +++ | +++ |
| IPD113Eq | SEQ ID NO: 69 | + | + | +++ | ++ | +++ |
| IPD113Dw | SEQ ID NO: 70 | + | ++ | +++ | +++ | ++++ |
| IPD113Dx | SEQ ID NO: 71 | + | + | + | ++ | ++++ |
| IPD113Dy | SEQ ID NO: 72 | + | + | ++ | ++ | +++ |
| IPD113Dz | SEQ ID NO: 73 | ++ | + | ++ | + | +++ |
| IPD113Daa | SEQ ID NO: 74 | + | + | +++ | +++ | +++ |
| IPD113Dab | SEQ ID NO: 75 | + | + | + | ++ | ND |
| IPD113Er | SEQ ID NO: 76 | + | + | +++ | +++ | ++++ |
| IPD113Es | SEQ ID NO: 77 | +++ | + | +++ | +++ | +++ |
| IPD113Gj | SEQ ID NO: 78 | + | + | + | + | + |
| IPD113Fm | SEQ ID NO: 79 | ++++ | + | + | + | + |
| IPD113Fn | SEQ ID NO: 80 | ++++ | ++ | + | + | + |
| IPD113Fo | SEQ ID NO: 81 | ++++ | ++ | + | ++ | + |
| IPD113Dac | SEQ ID NO: 82 | + | +++ | +++ | + | +++ |
| IPD113Dad | SEQ ID NO: 83 | + | + | ++ | + | ND |
| IPD113Fp | SEQ ID NO: 84 | + | + | + | ++ | + |
| IPD113Fq | SEQ ID NO: 85 | + | ++ | + | + | + |
| IPD113Fr | SEQ ID NO: 86 | + | ++ | +++ | + | + |
| IPD113Fs | SEQ ID NO: 87 | +++ | + | +++ | +++ | ++ |
| IPD113Dae | SEQ ID NO: 88 | + | + | + | +++ | +++ |
| IPD113Daf | SEQ ID NO: 89 | ++ | + | + | +++ | +++ |
| IPD113Dag | SEQ ID NO: 90 | ++ | + | + | ++ | +++ |
| IPD113Dah | SEQ ID NO: 91 | + | + | ++ | + | ND |
| IPD113Et | SEQ ID NO: 92 | + | + | + | ++ | ND |
| IPD113Eu | SEQ ID NO: 93 | ++++ | +++ | ++++ | ++++ | ++++ |
| IPD113Ev | SEQ ID NO: 94 | + | + | + | + | ND |
| IPD113Ew | SEQ ID NO: 95 | ++++ | ++ | ++++ | +++ | ++++ |
| IPD113Ex | SEQ ID NO: 96 | ++++ | +++ | ++++ | +++ | ++++ |
| IPD113Dai | SEQ ID NO: 97 | +++ | ++ | ++++ | +++ | ++++ |
| IPD113Daj | SEQ ID NO: 98 | ++++ | +++ | ++++ | +++ | ++++ |
| IPD113Dc_M28 | SEQ ID NO: 99 | ++++ | ++++ | ++++ | ++++ | ++++ |
| IPD113Dak | SEQ ID NO: 100 | ++ | + | +++ | + | ++++ |
| IPD113Dal | SEQ ID NO: 101 | +++ | +++ | +++ | + | ++++ |
| IPD113Dam | SEQ ID NO: 102 | ++ | ++ | ++++ | + | ++++ |
| IPD113Ey | SEQ ID NO: 103 | ++++ | ++ | ++++ | +++ | ++++ |
| IPD113Ez | SEQ ID NO: 104 | ++++ | ++ | ++++ | +++ | ++++ |
| IPD113Eaa | SEQ ID NO: 105 | ++++ | +++ | ++++ | +++ | ++++ |
| IPD113Eab | SEQ ID NO: 106 | +++ | ++ | ++++ | ++ | ++++ |
| IPD113Eac | SEQ ID NO: 107 | ++++ | ++ | ++++ | +++ | ++++ |
| IPD113Ft | SEQ ID NO: 108 | + | + | +++ | + | ND |
| IPD113Fv | SEQ ID NO: 109 | + | + | ++ | + | ND |
| IPD113Ead | SEQ ID NO: 110 | + | + | +++ | + | ++++ |
| IPD113Dan | SEQ ID NO: 111 | +++ | +++ | +++ | +++ | ++++ |
| IPD113Dao | SEQ ID NO: 112 | + | + | + | + | + |
| IPD113Dap | SEQ ID NO: 113 | ++++ | +++ | ++++ | +++ | ++++ |
| IPD113Daq | SEQ ID NO: 114 | +++ | +++ | ++++ | +++ | ++++ |
| IPD113Gk | SEQ ID NO: 115 | + | + | + | + | + |
| IPD113Gl | SEQ ID NO: 116 | + | + | ++ | ++ | + |
| IPD113Gm | SEQ ID NO: 117 | + | ++ | + | + | + |
| IPD113Gn | SEQ ID NO: 118 | + | + | + | + | + |
| IPD113Go | SEQ ID NO: 119 | + | + | + | + | + |
| IPD113Eai | SEQ ID NO: 120 | + | + | + | + | ND |
| IPD113Eae | SEQ ID NO: 121 | + | + | +++ | + | ND |
| IPD113Eah | SEQ ID NO: 122 | + | ++ | ++ | + | ND |
| IPD113Eaf | SEQ ID NO: 123 | + | + | + | + | ND |
| IPD113Eag | SEQ ID NO: 124 | ++ | +++ | +++ | ++ | ++++ |
| IPD113Fx | SEQ ID NO: 125 | + | + | ++ | + | + |
| IPD113Fw | SEQ ID NO: 126 | + | + | ++ | + | + |
| IPD113Ca | SEQ ID NO: 416 | − | + | − | − | − |
| IPD113Cb | SEQ ID NO: 417 | − | − | − | − | − |
| IPD113Be | SEQ ID NO: 418 | − | − | − | − | − |
| IPD113Bd | SEQ ID NO: 419 | − | − | − | + | − |
| IPD113Bf | SEQ ID NO: 420 | − | − | − | + | − |
| IPD113Eaj | SEQ ID NO: 421 | − | − | − | − | − |
| IPD113Dav | SEQ ID NO: 422 | + | ++ | ++ | + | ++ |
| IPD113Daw | SEQ ID NO: 423 | + | ++ | ++ | ++ | ++ |
| IPD113Dax | SEQ ID NO: 424 | + | ++ | ++ | + | +++ |
| IPD113Day | SEQ ID NO: 425 | ++ | ++ | ++ | + | ++ |
| IPD113Daz | SEQ ID NO: 426 | + | ++ | ++ | ++ | ++ |
| IPD113Dba | SEQ ID NO: 427 | + | ++ | ++ | ++ | ++ |
| IPD113Dar | SEQ ID NO: 428 | ++ | +++ | ++ | ++ | ++ |
| IPD113Das | SEQ ID NO: 429 | + | +++ | ++ | + | ++ |
| IPD113Dat | SEQ ID NO: 430 | + | ++ | ++ | + | ++ |
| IPD113Dau | SEQ ID NO: 431 | ++ | ++ | +++ | ++ | ++ |
| IPD113Dbb | SEQ ID NO: 432 | − | − | − | − | ++ |
| IPD113Dbd | SEQ ID NO: 433 | ++ | − | + | − | ++ |
| IPD113Dbe | SEQ ID NO: 434 | − | − | + | − | ++ |

TABLE 6-continued

|  |  | SBL | FAW | CEW | ECB | VBC |
|---|---|---|---|---|---|---|
| IPD113Dbc | SEQ ID NO: 435 | – | – | – | – | ++ |
| IPD113Fac | SEQ ID NO: 436 | ++ | ++ | – | + | ++ |
| IPD113Fad | SEQ ID NO: 437 | – | – | – | – | – |
| IPD113Fae | SEQ ID NO: 438 | – | + | – | – | – |
| IPD113Eak | SEQ ID NO: 439 | – | +++ | – | – | ++ |
| IPD113Eal | SEQ ID NO: 440 | – | +++ | – | – | ++ |
| IPD113Eam | SEQ ID NO: 441 | – | +++ | – | – | ++ |
| IPD113Gp | SEQ ID NO: 442 | – | – | – | – | – |
| IPD113Faa | SEQ ID NO: 443 | ++ | – | – | – | – |
| IPD113Fab | SEQ ID NO: 444 | – | – | – | – | – |
| IPD113Gq | SEQ ID NO: 445 | + | – | – | – | – |
| IPD113Fy | SEQ ID NO: 446 | – | – | – | – | – |
| IPD113Fz | SEQ ID NO: 447 | – | + | – | – | – |
| IPD113Dbf | SEQ ID NO: 448 | – | + | – | – | – |
| IPD113Dbi | SEQ ID NO: 449 | – | – | – | – | – |
| IPD113Dbg | SEQ ID NO: 450 | – | – | – | + | – |
| IPD113Dbh | SEQ ID NO: 451 | – | – | – | + | – |
| IPD113Faf | SEQ ID NO: 452 | – | – | – | + | – |
| IPD113Fah | SEQ ID NO: 453 | – | + | – | – | – |
| IPD113Fai | SEQ ID NO: 454 | – | – | – | – | – |
| IPD113Faj | SEQ ID NO: 455 | – | – | – | – | – |
| IPD113Fak | SEQ ID NO: 456 | – | – | – | – | – |
| IPD113Fag | SEQ ID NO: 457 | – | – | – | – | – |
| IPD113Eas | SEQ ID NO: 458 | – | – | – | + | – |
| IPD113Eat | SEQ ID NO: 459 | – | – | – | – | – |
| IPD113Eau | SEQ ID NO: 460 | – | – | – | + | – |
| IPD113Eay | SEQ ID NO: 461 | + | + | – | + | – |
| IPD113Eav | SEQ ID NO: 462 | – | – | – | – | – |
| IPD113Eaw | SEQ ID NO: 463 | + | + | ++ | + | ++ |
| IPD113Df_C_TR1 | SEQ ID NO: 464 | – | – | – | – | – |
| IPD113Eap_C_TR1 | SEQ ID NO: 465 | – | – | – | – | – |
| IPD113Eaq | SEQ ID NO: 466 | – | – | – | + | – |
| IPD113Eao | SEQ ID NO: 467 | – | – | – | – | – |
| IPD113Ean | SEQ ID NO: 468 | – | – | – | – | – |
| IPD113Ear | SEQ ID NO: 469 | – | + | – | – | – |
| IPD113Eap | SEQ ID NO: 470 | – | ++ | – | – | ++ |
| IPD113Fal | SEQ ID NO: 471 | – | – | – | – | – |
| IPD113Dbj | SEQ ID NO: 472 | ++ | ++ | ++ | + | +++ |
| IPD113Dbk | SEQ ID NO: 473 | – | ++ | ++ | + | ++ |
| IPD113Dbl | SEQ ID NO: 474 | – | ++ | – | – | – |
| IPD113Fam | SEQ ID NO: 475 | – | + | + | – | – |
| IPD113Fan | SEQ ID NO: 476 | – | – | – | – | – |
| IPD113Fao | SEQ ID NO: 477 | – | – | + | + | – |
| IPD113Eax_N_TR1 | SEQ ID NO: 478 | +++ | + | +++ | ++ | +++ |
| IPD113Eax | SEQ ID NO: 479 | +++ | + | +++ | ++ | +++ |
| IPD113Eaz | SEQ ID NO: 480 | + | ++ | ++ | ++ | ++ |
| IPD113Eba | SEQ ID NO: 481 | – | + | ++ | + | ++ |
| IPD113Ebc | SEQ ID NO: 482 | + | – | ++ | – | ++ |
| IPD113Ebd | SEQ ID NO: 483 | + | – | ++ | – | + |
| IPD113Ebf | SEQ ID NO: 484 | ++ | – | ++ | – | ++ |
| IPD113Ebe | SEQ ID NO: 485 | + | – | +++ | – | ++ |
| IPD113Ebb | SEQ ID NO: 486 | – | – | + | + | ++ |
| IPD113Dbm | SEQ ID NO: 487 | – | – | ++ | + | ++ |
| IPD113Cc | SEQ ID NO: 488 | – | – | – | – | +++ |
| IPD113Ebk | SEQ ID NO: 489 | ++ | + | +++ | – | +++ |
| IPD113Ebj | SEQ ID NO: 490 | ++ | ++ | ++ | – | +++ |
| IPD113Far | SEQ ID NO: 491 | – | + | – | – | + |
| IPD113Faq | SEQ ID NO: 492 | – | + | – | – | – |
| IPD113Fap | SEQ ID NO: 493 | – | – | – | – | – |
| IPD113Ebh | SEQ ID NO: 494 | – | – | – | + | – |
| IPD113Ebi | SEQ ID NO: 495 | – | + | – | – | – |
| IPD113Ebg | SEQ ID NO: 496 | – | – | – | – | – |

Example 6—Lepidoptera Assays with Purified IPD113 Proteins Expressed in *E. coli*

Selected IPD113 homologs were subcloned from their respective transient expression vectors into the NdeI/BamHI sites of *E. coli* expression vector pET16B containing a N-terminal 10×His tag. pET16B plasmid DNA, containing the respective IPD113 gene insert, was transformed into competent C41 *E. coli* cells for recombinant protein expression. *E. coli* cells were grown overnight at 30° C. with ampicillin selection then inoculated into fresh 2XYT medium (1:50) and further grown at 37° C. to an optical density of about 0.7. At that point cells were chilled then induced with 1 mM IPTG. Cultures were further grown at 16° C. for 20 hours to induce protein expression. The *E. coli* expressed proteins were purified by immobilized metal ion chromatography using Ni-NTA agarose (Qiagen™ Germany) according to the manufacturer's protocols. Purified fractions were loaded onto Zeba™ Spin desalting columns (Thermo Scientific) pre-equilibrated with 1×TBS buffer (25 mM Tris pH8+150 mM NaCl). The eluted protein was run in diet assays to evaluate the insecticidal protein effects on larvae of corn earworm (CEVV) (*Helicoverpa zea*), European corn borer (ECB) (*Ostrinia nubialis*), fall armyworm (FAVV) (*Spodoptera frugiperda* JE Smith), soybean looper (SBL) (*Pseudoplusia includens*), and velvet bean caterpillar (VBC) (*Anticarsia gemmatalis* Hübner). Bioassays against the five pest species, were conducted using a dilution series of purified N-10×His-IPD113 polypeptides incorporated into an agar-based Lepidoptera diet (Southland Products Inc., Lake Village, Ark.) in a 96-well plate format. Four replicates were used per sample. Two to five neonate insects were placed into each well of the treated plate. After four days of incubation at 28° C., larvae were scored for mortality or severity of stunting. The scores were recorded numerically as dead (3), severely stunted (2) (little or no growth but alive and equivalent to a 1st instar larvae), stunted (1) (growth to second instar but not equivalent to controls), or normal (0). The activity of a series of IPD113 homologs is summarized in Table 7, where a "+" denotes seeing at least stunting (average score of 1) at the highest dose tested and a "–" denotes no stunting at the dose tested.

TABLE 7

| Protein | Top dose (ppm) | SBL | FAW | ECB | CEW | VBC | WCRW |
|---|---|---|---|---|---|---|---|
| IPD113Da | 592 | + | + | + | + | NT | NT |
| IPD113Da | 509 | + | NT | NT | NT | + | – |
| IPD113Db | 967 | + | + | + | + | + | NT |
| IPD113Db | 942 | + | NT | NT | NT | + | – |
| IPD113Di | 521 | + | + | + | + | + | NT |
| IPD113Df | 1200 | + | + | + | + | + | NT |
| IPD113Dh | 633 | + | + | + | + | + | – |
| IPD113Dg | 1313 | + | + | + | + | + | NT |
| IPD113Dn | 304 | + | + | + | + | + | NT |
| IPD113Ei | 240 | + | + | + | + | + | NT |
| IPD113Fh | 140 | – | – | – | – | – | NT |
| IPD113Fi | 133 | – | – | – | – | – | NT |
| IPD113Gd | 483 | – | – | – | – | – | NT |
| IPD113Dp | ~30 | + | – | + | + | + | NT |
| IPD113Dr | 538 | – | + | + | + | + | NT |
| IPD113Ds (M18 Start) | ~50 | + | + | + | + | + | NT |
| IPD113Daj | 262 | + | + | + | + | + | NT |
| IPD113Dap | 650 | + | + | + | + | + | NT |
| IPD113Daq | 750 | + | + | + | + | + | NT |
| IPD113Dan | 767 | + | – | + | + | + | NT |
| IPD113Dc_M28 | 671 | + | + | + | + | + | NT |
| IPD113Dc | 600 | + | + | + | + | + | NT |
| IPD113Eaa | ~38 | + | – | + | + | + | NT |

"NT" denotes not tested;; "SBL" denotes Soybean Looper; "FAW" denotes Fall Armyworm; "ECB" denotes Eastern Corn Borer; "CEW" denotes Corn Earworm; "ECB" denotes Eastern Corn Borer; "VBC" denotes Velvet Bean Caterpillar; "WCRW" denotes Western Corn Rootworm

Example 7—Construction of IPD113 Chimeras and Variants with Multiple Amino Acid Substitutions To generate active variants with diversified sequences, chimeras between IPD113Aa (SEQ ID NO: 1) and IPD113Db (SEQ ID NO: 10) were generated by multi-PCR fragment overlap assembly. A total of ten chimeras between IPD113Aa and IPD113Db were constructed and cloned into a plant transient vector containing the DMMV promoter. Additionally, variants of IPD113Aa with multiple amino acid changes were generated by family shuffling (Chia-Chun J. Chang et al, 1999, *Nature Biotechnology* 17, 793-797) the polynucleotide sequences encoding IPD113Aa (SEQ ID NO: 1) and IPD113Db (SEQ ID NO: 10). In this variant library, a codon optimized polynucleotide sequence of IPD113Aa (SEQ ID NO: 331) and the native polynucleotide sequence of IPD113Db (SEQ ID NO: 136) were used as library parents. Library variants were cloned into a plant transient vector containing the DMMV promoter. Both chimera and family shuffle variants were screened using a bush bean transient expression system as described in Example 3.

Sequence identity of IPD113Aa variants was calculated using the Needleman-Wunsch algorithm, as implemented in the Needle program (EMBOSS tool suite). The percent identity compared to IPD113Aa (SEQ ID NO: 1), variant designation, nucleotide sequences, and amino acid sequences of the resulting IPD113Aa variants are summarized in Table 8.

TABLE 8

| % Identity to IPD113Aa (SEQ ID NO: 1) | Variant | Polynucleotide | Polypeptide |
|---|---|---|---|
| 71.3 | IPD113Aa_Db_Chim_01 | SEQ ID NO: 282 | SEQ ID NO: 253 |
| 88.9 | IPD113Aa_Db_Chim_02 | SEQ ID NO: 283 | SEQ ID NO: 254 |
| 74.7 | IPD113Aa_Db_Chim_03 | SEQ ID NO: 284 | SEQ ID NO: 255 |
| 85.5 | IPD113Aa_Db_Chim_04 | SEQ ID NO: 285 | SEQ ID NO: 256 |
| 79.4 | IPD113Aa_Db_Chim_05 | SEQ ID NO: 286 | SEQ ID NO: 257 |
| 80.8 | IPD113Aa_Db_Chim_06 | SEQ ID NO: 287 | SEQ ID NO: 258 |
| 90.3 | IPD113Aa_Db_Chim_07 | SEQ ID NO: 288 | SEQ ID NO: 259 |
| 69.8 | IPD113Aa_Db_Chim_08 | SEQ ID NO: 289 | SEQ ID NO: 260 |
| 93.1 | IPD113Aa_Db_Chim_09 | SEQ ID NO: 290 | SEQ ID NO: 261 |
| 67.0 | IPD113Aa_Db_Chim_10 | SEQ ID NO: 291 | SEQ ID NO: 262 |
| 63.6 | XP-113FSlibDb#2 | SEQ ID NO: 292 | SEQ ID NO: 263 |
| 73.2 | XP-113FSlibDb#3 | SEQ ID NO: 293 | SEQ ID NO: 264 |
| 67.8 | XP-113FSlibDb#5 | SEQ ID NO: 294 | SEQ ID NO: 265 |
| 66.2 | XP-113FSlibDb#6 | SEQ ID NO: 295 | SEQ ID NO: 266 |
| 76.2 | XP-113FSlibDb#9 | SEQ ID NO: 296 | SEQ ID NO: 267- |
| 65.4 | XP-113FSlibDb#11 | SEQ ID NO: 297 | SEQ ID NO: 268 |
| 64.5 | XP-113FSlibDb#12 | SEQ ID NO: 298 | SEQ ID NO: 269 |
| 62.6 | XP-113FSlibDb#13 | SEQ ID NO: 299 | SEQ ID NO: 270 |
| 65.8 | XP-113FSlibDb#16 | SEQ ID NO: 300 | SEQ ID NO: 271 |
| 68.4 | XP-113FSlibDb#17 | SEQ ID NO: 301 | SEQ ID NO: 272 |
| 70.4 | XP-113FSlibDb#18 | SEQ ID NO: 302 | SEQ ID NO: 273 |
| 66.5 | XP-113FSlibDb#19 | SEQ ID NO: 303 | SEQ ID NO: 274 |
| 65.6 | XP-113FSlibDb#20 | SEQ ID NO: 304 | SEQ ID NO: 275 |
| 81 | XP-113FSlibDb#21 | SEQ ID NO: 305 | SEQ ID NO: 276 |
| 66.2 | XP-113FSlibDb#24 | SEQ ID NO: 306 | SEQ ID NO: 277 |
| 63.2 | XP-113FSlibDb#25 | SEQ ID NO: 307 | SEQ ID NO: 278 |
| 62.8 | XP-113FSlibDb#26 | SEQ ID NO: 308 | SEQ ID NO: 279 |
| 62.6 | XP-113FSlibDb#29 | SEQ ID NO: 309 | SEQ ID NO: 280 |
| 76.2 | XP-113FSlibDb#30 | SEQ ID NO: 310 | SEQ ID NO: 281 |

The activity spectra for tested IPD113Aa variants are summarized in Table 9, where a "++++" indicates an average activity score of <=10% of leaf disc consumed, a "+++" indicates an average activity score of 11-50% leaf disc consumed, a "+" indicates an average activity score of 51-70% leaf disc consumed, a 4' indicates an average activity score of >70% leaf disc consumed, and "ND" indicates not determined.

TABLE 9

| IPD113 Variant | | SBL | FAW | CEW | ECB | VBC |
|---|---|---|---|---|---|---|
| IPD113Aa_Db_Chim_01 | SEQ ID NO: 253 | ++++ | ++ | +++ | ND | ++++ |
| IPD113Aa_Db_Chim_02 | SEQ ID NO: 254 | + | + | ++ | ND | + |
| IPD113Aa_Db_Chim_03 | SEQ ID NO: 255 | + | + | + | ND | + |
| IPD113Aa_Db_Chim_04 | SEQ ID NO: 256 | + | + | + | ND | + |
| IPD113Aa_Db_Chim_05 | SEQ ID NO: 257 | + | + | + | ND | + |
| IPD113Aa_Db_Chim_06 | SEQ ID NO: 258 | + | + | ++ | ND | + |
| IPD113Aa_Db_Chim_07 | SEQ ID NO: 259 | + | + | + | ND | + |
| IPD113Aa_Db_Chim_08 | SEQ ID NO: 260 | +++ | + | ++ | ND | +++ |
| IPD113Aa_Db_Chim_09 | SEQ ID NO: 261 | + | + | + | ND | ++ |
| IPD113Aa_Db_Chim_10 | SEQ ID NO: 262 | + | + | + | ND | + |
| XP-113FSlibDb#2 | SEQ ID NO: 263 | ++ | + | ++++ | + | ++++ |
| XP-113FSlibDb#3 | SEQ ID NO: 264 | + | + | + | + | + |
| XP-113FSlibDb#5 | SEQ ID NO: 265 | + | + | + | + | + |
| XP-113FSlibDb#6 | SEQ ID NO: 266 | + | + | + | + | + |
| XP-113FSlibDb#9 | SEQ ID NO: 267- | + | + | + | + | ++ |
| XP-113FSlibDb#11 | SEQ ID NO: 268 | +++ | + | +++ | + | ++++ |
| XP-113FSlibDb#12 | SEQ ID NO: 269 | + | + | + | + | + |
| XP-113FSlibDb#13 | SEQ ID NO: 270 | +++ | + | +++ | + | ++++ |
| XP-113FSlibDb#16 | SEQ ID NO: 271 | + | + | ++ | + | +++ |
| XP-113FSlibDb#17 | SEQ ID NO: 272 | + | + | +++ | + | ++++ |
| XP-113FSlibDb#18 | SEQ ID NO: 273 | + | + | + | + | + |
| XP-113FSlibDb#19 | SEQ ID NO: 274 | + | + | + | + | +++ |
| XP-113FSlibDb#20 | SEQ ID NO: 275 | + | + | ++ | + | ++ |
| XP-113FSlibDb#21 | SEQ ID NO: 276 | + | + | + | + | + |
| XP-113FSlibDb#24 | SEQ ID NO: 277 | + | + | ++++ | + | +++ |
| XP-113FSlibDb#25 | SEQ ID NO: 278 | +++ | +++ | +++ | + | ++++ |
| XP-113FSlibDb#26 | SEQ ID NO: 279 | + | + | + | + | +++ |
| XP-113FSlibDb#29 | SEQ ID NO: 280 | ++ | + | ++ | + | ++++ |
| XP-113FSlibDb#30 | SEQ ID NO: 281 | + | + | +++ | + | + |

Example 8—Chimeras Between IPD113 Homologs

To generate active variants with diversified sequences, chimeras between IPD113 homologs were generated by multi-PCR fragment overlap assembly. Chimeras between selected IPD113 homologs were constructed and cloned into a plant transient vector containing the DMMV promoter. Chimera variants were screened using a bush bean transient expression system as described in Example 3.

Sequence identity of chimeras to IPD113Aa was calculated using the Needleman-Wunsch algorithm, as implemented in the Needle program (EMBOSS tool suite). The percent identity compared to IPD113Aa (SEQ ID NO: 1), variant designation, chimera parents, nucleotide sequences, and amino acid sequences of the resulting IPD113 chimeras are summarized in Table 10.

TABLE 10

| % Identity to IPD113Aa (SEQ ID NO: 1) | Variant | Parent 1 | Parent 2 | Polynucleotide | Polypeptide |
|---|---|---|---|---|---|
| 89.9 | pAL-1942 | IPD113Aa | IPD113DH | SEQ ID NO: 321 | SEQ ID NO: 311 |
| 81.4 | pAL-1943 | IPD113Bb | IPD113DH | SEQ ID NO: 322 | SEQ ID NO: 312 |
| 60.7 | pAL-1944 | IPD113Df | IPD113DH | SEQ ID NO: 323 | SEQ ID NO: 313 |
| 62.4 | pAL-1945 | IPD113Dr | IPD113DH | SEQ ID NO: 324 | SEQ ID NO: 314 |
| 51.3 | pAL-1946 | IPD113Fl | IPD113DH | SEQ ID NO: 325 | SEQ ID NO: 315 |
| 73.2 | pAL-1998 | IPD113DH | IPD113Aa | SEQ ID NO: 326 | SEQ ID NO: 316 |
| 69.9 | pAL-1999 | IPD113DH | IPD113Bb | SEQ ID NO: 327 | SEQ ID NO: 317 |
| 63.1 | pAL-2000 | IPD113DH | IPD113Df | SEQ ID NO: 328 | SEQ ID NO: 318 |
| 61.8 | pAL-2001 | IPD113DH | IPD113Dr | SEQ ID NO: 329 | SEQ ID NO: 319 |
| 61.1 | pAL-2002 | IPD113DH | IPD113Fl | SEQ ID NO: 330 | SEQ ID NO: 320 |

The activity spectra for tested IPD113 chimeras are summarized in Table 11, where a "++++" indicates an average activity score of <=10% of leaf disc consumed, a "+++" indicates an average activity score of 11-50% leaf disc consumed, a "++" indicates an average activity score of 51-70% leaf disc consumed, a 4' indicates an average activity score of >70% leaf disc consumed, and "ND" indicates not determined.

TABLE 11

| | SBL | FAW | CEW | ECB | VBC |
|---|---|---|---|---|---|
| pAL-1942 | + | + | ++ | + | +++ |
| pAL-1943 | + | + | + | + | + |
| pAL-1944 | +++ | ++++ | +++ | +++ | ++++ |
| pAL-1945 | +++ | +++ | ++++ | +++ | ++++ |
| pAL-1946 | + | +++ | + | + | ++ |
| pAL-1998 | + | +++ | + | ++ | +++ |
| pAL-1999 | + | + | + | + | + |
| pAL-2000 | +++ | +++ | ++++ | +++ | ++++ |
| pAL-2001 | + | + | + | + | +++ |
| pAL-2002 | + | + | + | + | + |

Example 9—Vector Constructs for Expression of IPD113 Polypeptides in Plants

For testing in maize an expression vector, VECTOR 1, was constructed to include a transgene cassette containing a gene design encoding IPD113Dh (SEQ ID NO: 16), with the MMV ENH:MMV ENH:BYDV promoter (PCT Pub. No. WO2017095698) and maize ADH1 intron 1 linked to the OS-UBI terminator (PCT Pub. No. WO2018102131) and an expression vector, VECTOR 2, was constructed to include a transgene cassette containing a gene design encoding IPD113Dh (SEQ ID NO: 16), with the maize ubiquitin promoter linked to the PINII terminator (US Publication No. 20140130205).

Example 10—*Agrobacterium*-Mediated Stable Transformation of Maize

For *Agrobacterium*-mediated maize transformation of insecticidal polypeptides, the method of Cho was employed (M. J. Cho et al., *Plant Cell Rep.* 33, 1767-1777 (2014)) using PMI with mannose selection. Briefly, immature embryos (IEs) were isolated from maize and infected with an *Agrobacterium* suspension containing vector constructs for the expression of IPD113. IEs and *Agrobacterium* were co-cultivated on solid medium in the dark at 21° C. for 3 days and subsequently transferred to resting medium without selection agent but supplemented with carbenicillin (ICN, Costa Mesa, Calif., USA) to eliminate *Agrobacterium*. IEs were transferred to the appropriate resting medium for 10-11 days before transferring to PMI medium containing mannose (Sigma-Aldrich Corp, St Louis, Mo., USA) with antibiotic(s). Multiple rounds of selection were performed until sufficient quantities of tissue were obtained. Regenerative green tissues were transferred to PHI-XM medium (E. Wu et al., *In Vitro Cell. Dev. Biol.* Plant 50, 9-18 (2014)) with mannose selection. Shoots were transferred to tubes containing MSB rooting medium for rooting and plantlets transplanted to soil in pots in the greenhouse.

Example 11—Insect Control Efficacy of Stable Transformed Corn Plants Against a Spectrum of Lepidopteran Insects Leaf discs were excised from transformed maize plants and tested for insecticidal activity of IPD113Dh polypeptide (SEQ ID NO: 16) against the European Corn Borer (ECB) (*Ostrinia nubilalis*), Corn Earworm, (CEW) (*Helicoverpa zea*), and Fall Armyworm (*Spodoptera frugiperda*). The constructs VECTOR 1 and VECTOR 2 for the expression of IPD113Dh (SEQ ID NO: 16) were used to generate transgenic maize events to test for efficacy against feeding damage caused by lepidopteran pests provided by expression of these polypeptides. FIG. 5 shows the protection from leaf feeding by European Corn Borer (ECB) (*Ostrinia nubilalis*), Corn Earworm, (CEW) (*Helicoverpa zea*), and Fall Armyworm (*Spodoptera frugiperda*) was conferred by expression of IPD113Dh gene (SEQ ID NO: 142).

Example 12—Transformation and Regeneration of Soybean (*Glycine max*)

Transgenic soybean lines are generated by the method of particle gun bombardment (Klein et al., *Nature* (London) 327:70-73 (1987); U.S. Pat. No. 4,945,050) using a BIO-RAD Biolistic PDS1000/He instrument and either plasmid or fragment DNA. The following stock solutions and media are used for transformation and regeneration of soybean plants:
Stock Solutions:
Sulfate 100× Stock:
  37.0 g $MgSO_4.7H_2O$, 1.69 g $MnSO_4.H_2O$, 0.86 g $ZnSO_4.7H_2O$, 0.0025 g $CuSO_4.5H_2O$
Halides 100× Stock:
  30.0 g $CaCl_2.2H_2O$, 0.083 g KI, 0.0025 g $CoCl_2.6H_2O$
P, B, Mo 100× Stock:
  18.5 g $KH_2PO_4$, 0.62 g $H_3BO_3$, 0.025 g $Na_2MoO_4.2H_2O$
Fe EDTA 100× Stock:
  3.724 g $Na_2EDTA$, 2.784 g $FeSO_4.7H_2O$
2,4-D Stock:
  10 mg/mL Vitamin
B5 vitamins, 1000× Stock:
  100.0 g myo-inositol, 1.0 g nicotinic acid, 1.0 g pyridoxine HCl, 10 g thiamine.HCL.
Media (Per Liter):
SB199 Solid Medium:
  1 package MS salts (Gibco/BRL—Cat. No. 11117-066), 1 mL B5 vitamins 1000× stock, 30 g Sucrose, 4 ml 2, 4-D (40 mg/L final concentration), pH 7.0, 2 g Gelrite
SB1 Solid Medium:
  1 package MS salts (Gibco/BRL—Cat. No. 11117-066), 1 mL B5 vitamins 1000× stock, 31.5 g Glucose, 2 mL 2, 4-D (20 mg/L final concentration), pH 5.7, 8 g TC agar
SB196:
  10 mL of each of the above stock solutions 1-4, 1 mL B5 Vitamin stock, 0.463 g (NH4)2 SO4, 2.83 g KNO3, 1 mL 2,4 D stock, 1 g asparagine, 10 g Sucrose, pH 5.7
SB71-4:
  Gamborg's B5 salts, 20 g sucrose, 5 g TC agar, pH 5.7.
SB103:
  1 pk. Murashige & Skoog salts mixture, 1 mL B5 Vitamin stock, 750 mg MgCl2 hexahydrate, 60 g maltose, 2 g gelrite, pH 5.7.
SB166:
  SB103 supplemented with 5 g per liter activated charcoal.
Soybean Embryogenic Suspension Culture Initiation:
  Pods with immature seeds from available soybean plants 45-55 days after planting are picked, removed from their shells and placed into a sterilized magenta box. The soybean seeds are sterilized by shaking them for 15 min in a 5% Clorox® solution with 1 drop of ivory soap (i.e., 95 mL of autoclaved distilled water plus 5 mL Clorox® and 1 drop of soap, mixed well). Seeds are rinsed using 2, 1-liter bottles of sterile distilled water and those less than 3 mm are placed on individual microscope slides. The small end of the seed is cut and the cotyledons pressed out of the seed coat. Cotyledons are transferred to plates containing SB199 medium (25-30 cotyledons per plate) for 2 weeks, then transferred to SB1 for 2-4 weeks. Plates are wrapped with fiber tape. After this time, secondary embryos are cut and placed into SB196 liquid medium for 7 days.
Culture Conditions:
  Soybean embryogenic suspension cultures (cv. 93Y21) were maintained in 50 mL liquid medium SB196 on a rotary shaker, 100-150 rpm, 26° C. on 16:8 h day/night photoperiod at light intensity of 80-100 µE/m2/s. Cultures are subcultured every 7-14 days by inoculating up to %2 dime size quantity of tissue (clumps bulked together) into 50 mL of fresh liquid SB196.
Preparation of DNA for Bombardment:
  In particle gun bombardment procedures it is possible to use purified 1) entire plasmid DNA; or 2) DNA fragments containing only the recombinant DNA expression cassette(s) of interest. For every seventeen bombardment transformations, 85 µL of suspension is prepared containing 1 to 90 picograms (pg) of plasmid DNA per base pair of each DNA plasmid. DNA plasmids or fragments are co-precipitated onto gold particles as follows. The DNAs in suspension are added to 50 µL of a 10-60 mg/mL 0.6 µm gold particle suspension and then combined with 50 µL $CaCl_2$ (2.5 M) and 20 µL spermidine (0.1 M). The mixture is vortexed for 5 sec, spun in a microfuge for 5 sec, and the supernatant removed.

The DNA-coated particles are then washed once with 150 μL of 100% ethanol, vortexed and spun in a microfuge again, then resuspended in 85 μL of anhydrous ethanol. Five μL of the DNA-coated gold particles are then loaded on each macrocarrier disk.

Tissue Preparation and Bombardment with DNA:

Approximately 100 mg of two-week-old suspension culture is placed in an empty 60 mm×15 mm petri plate and the residual liquid removed from the tissue using a pipette. The tissue is placed about 3.5 inches away from the retaining screen and each plate of tissue is bombarded once. Membrane rupture pressure is set at 650 psi and the chamber is evacuated to −28 inches of Hg. Following bombardment, the tissue from each plate is divided between two flasks, placed back into liquid media, and cultured as described above.

Selection of Transformed Embryos and Plant Regeneration:

After bombardment, tissue from each bombarded plate is divided and placed into two flasks of SB196 liquid culture maintenance medium per plate of bombarded tissue. Seven days post bombardment, the liquid medium in each flask is replaced with fresh SB196 culture maintenance medium supplemented with 100 ng/mL selective agent (selection medium). For selection of transformed soybean cells the selective agent used can be a sulfonylurea (SU) compound with the chemical name, 2-chloro-N-((4-methoxy-6 methy-1,3,5-triazine-2-yl)aminocarbonyl) benzenesulfonamide (common names: DPX-W4189 and Chlorsulfuron). Chlorsulfuron is the active ingredient in the DuPont sulfonylurea herbicide, GLEAN®. The selection medium containing SU is replaced every two weeks for 8 weeks. After the 8 week selection period, islands of green, transformed tissue are observed growing from untransformed, necrotic embryogenic clusters. These putative transgenic events are isolated and kept in SB196 liquid medium with SU at 100 ng/mL for another 5 weeks with media changes every 1-2 weeks to generate new, clonally propagated, transformed embryogenic suspension cultures. Embryos spend a total of around 13 weeks in contact with SU. Suspension cultures are subcultured and maintained as clusters of immature embryos and also regenerated into whole plants by maturation and germination of individual somatic embryos.

Somatic embryos became suitable for germination after four weeks on maturation medium (1 week on SB166 followed by 3 weeks on SB103). They are then removed from the maturation medium and dried in empty petri dishes for up to seven days. The dried embryos are then planted in SB71-4 medium where they are allowed to germinate under the same light and temperature conditions as described above. Germinated embryos are transferred to potting medium and grown to maturity for seed production.

Example 13—Identification of Amino Acid Positions Affecting the Protein Stability and Function of IPD113

To identify amino acid positions affecting protein structural stability and insecticidal function of IPD113, saturation mutagenesis was performed on selected positions within IPD113Dap (SEQ ID: 113). Mutants were generated by site directed mutagenesis. Resulting library variants were transformed into *E. coli* cells then picked and cultured in 96-well plates for protein expression. Cell lysates were generated by B-PER® Protein Extraction Reagent from Thermo Scientific (3747 N Meridian Rd, Rockford, Ill. USA 61101) and screened for FAW insecticidal activity.

Table 12 summarizes the amino acid substitutions identified at each mutagenized position of IPD113Dap (SEQ ID: 113) and amino acid substitutions allowing retention of insecticidal activity.

TABLE 12

| AA | Position | Identified substitutions | Active substitutions |
|---|---|---|---|
| R | 043 | G, A, V, L, I, M, W, F, P, S, T, C, Y, Q, E, K, H | |
| R | 045 | A, K | A, K |
| K | 057 | G, A, V, L, I, S, C, Y, N, Q, R | G, A, V, L, I, S, C, Y, N, Q, R |
| R | 064 | I, W, S, Y, D, K | I, W, S, D, D, K |
| K | 074 | G, A, V, L, M, F, P, S, T, C, Y, Q, D, E, R, H | G, V, L, M, F, S, T, C, Q, D, E, R |
| K | 082 | G, M, F, P, S, C, Y, N, E, R, H | G, M, F, P, S, C, Y, N, E, R, H |
| L | 083 | G, A, V, I, W, F, S, T, C, Y, N, D, K, R | G, A, V, I, W, F, S, T, C, Y, N, D, R |
| R | 088 | G, A, V, L, M, W, F, P, S, T, C, Y, N, Q, D, E, H | G, A, V, L, M, W, F, P, S, T, C, Y, N, Q, D, E, H |
| E | 094 | G, A, V, L, I, P, S, T, Q, D, K, R, H | G, A, V, L, I, P, S, T, Q, D, K, R, H |
| L | 100 | G, A, V, W, F, S, T, N, Q, D, R | A, V, W, F, S, T, Q, R |
| R | 101 | G, A, V, L, I, M, W, F, S, T, C, Y, N, Q, E, H | G, A, V, L, I, M, W, F, S, T, C, Y, N, Q, E, H |
| R | 116 | G, M, W, S, T | G, M, W, S, T |
| E | 124 | L, S, R | L, S, R |
| K | 125 | A, Q, E, R | A, Q, E, R |
| R | 142 | G, A, V, L, I, M, W, F, S, T, C, Y, Q, D, E, K, H | G, A, V, L, I, M, W, F, S, T, C, Y, Q, D, E, K, H |
| R | 144 | G, A, V, L, I, M, F, S, T, C, Y, N, Q, D, E, H | G, A, V, L, I, M, F, S, T, C, Y, N, Q, D, E, H |
| E | 169 | A, I | A, I |
| R | 170 | G, A, F, P, Y, K | G, A, F, P, Y, K |
| E | 175 | G, A, V, L, I, M, W, F, P, C, Y, N, Q, D, K, R, H | G, A, V, L, I, M, W, F, P, C, Y, N, Q, D, K, R, H |
| E | 176 | G, V, L, M, T | G, V, L, M, T |
| K | 193 | G, A, V, L, S, T, C, Y, N, Q, D | G, A, V, L, S, T, C, Y, N, Q, D |
| R | 196 | G, A, V, L, M, P, S, T, C, Y, N, Q | G, A, V, L, M, P, S, T, C, Y, N, Q |
| Y | 197 | G, A, V, L, M, W, F, P, S, N, D, R, H | W, F |
| N | 204 | G, A, V, I, W, F, S, T, C, Y, E, R | G, A, V, I, W, S, T, C, Y, E, R |
| K | 207 | G, A, V, L, I, W, S, T, Y, N, D, R, H | G, A, V, L, I, W, S, T, Y, N, D, R, H |
| R | 208 | G, V, L, I, F, S, T, C, Y, N, Q, E, K | G, V, L, I, F, S, T, C, Y, N, Q, E, K |
| K | 210 | G, A, V, S, Q, R | G, A, V, S, Q, R |
| R | 213 | V, L, F, Y, H | V, L, F, Y, H |
| E | 218 | G, A, V, L, M, W, F, P, S, T, C, Y, N, Q, K, R | G, A, V, L, M, W, F, P, S, T, C, Y, N, Q, K, R |
| R | 220 | G, A, V, L, S, T, C, Y, N, D, E, K, H | G, A, V, L, S, T, C, Y, N, D, E, K, H |
| R | 224 | G, V, L, M, W, F, S, T, Q, K, H | G, V, L, M, W, F, S, T, Q, K, H |
| R | 225 | V, P, T, K | V, P, T, K |
| R | 234 | | |
| D | 236 | G, A, V, P, S, N, Q | G, A, V, P, S, N, Q |
| E | 243 | G, V, L, F, S, Y, K, R | G, V, L, F, S, Y, K, R |
| D | 244 | C | C |
| K | 245 | G, V, L, F, S, T, C, Y, N, D, E, R, H | G, V, L, F, S, T, C, Y, N, D, E, R, H |
| R | 258 | A, V, L, I, M, W, S, T, C, Y, N, D, K | A, V, L, I, M, W, S, T, C, Y, N, D, K |
| E | 266 | G, A, V, L, M, S, T, Y, N, Q, D, K, R, H | G, A, V, L, M, S, T, Y, N, Q, D, K, R, H |
| K | 272 | G, A, V, L, I, M, W, F, S, T, Y, N | G, A, V, L, I, M, W, F, S, T, Y, N |
| R | 274 | G, A, L, S, C, Y | G, A, L, S, C, Y |
| K | 295 | G, A, V, L, W, P, S, T, C, Q, E, R | G, A, V, L, W, P, S, T, C, Q, E, R |
| N | 300 | G, A, V, L, M, W, P, S, T, C, Y, Q, D, E, R, H | G, A, V, L, M, W, P, S, T, C, Y, D, E, R, H |
| A | 303 | G, V, L, M, W, F, S, C, D, E, K, R | G, V, L, M, W, S, C, D, E, K, R |

TABLE 12-continued

| AA | Position | Identified substitutions | Active substitutions |
|---|---|---|---|
| R | 310 | G, A, V, L, I, M, W, F, P, S, T, C, Y, D, E, K, H | G, A, V, L, I, M, W, F, P, S, T, C, Y, D, E, K, H |
| L | 317 | G, V, I, M, W, F, S, T, Y, Q, D, K, R | V, I, M, W, F, S, T, D, K, R |
| R | 318 | K | K |
| D | 324 | G, C | G, C |
| W | 330 | G, A, V, L, I, M, F, S, T, E, K, R, H | I, F |
| K | 334 | R | R |
| R | 337 | A, V, L, W, S, T, Q, H | A, V, L, W, S, T, Q, H |
| R | 339 | G, A, V, L, M, W, F, S, T, C, Y, N, D, E, K, H | G, A, V, L, M, W, F, S, T, C, Y, N, D, E, K, H |
| R | 342 | L, T | L, T |
| D | 344 | | |
| R | 348 | G, V, L | G, V, L |
| D | 349 | G, V, F | G, V, F |
| R | 350 | G, A, V, L, I, M, S, Y, N, D, K, H | G, A, V, L, I, M, S, Y, N, D, K, H |
| E | 353 | G, A, V, L, M, W, F, P, S, C, Y, D, K, R, H | G, A, V, L, M, W, F, P, S, C, Y, D, K, R, H |
| R | 357 | L, I, S, K | L, I, S, K |
| D | 363 | V | V |
| S | 379 | G, A, V, L, W, P, T, C, Y, Q, D, R | A, V, L, W, P, T, C, Y, D, R |
| T | 387 | G, A, L, I, M, P, S, Q, D | G, A, L, I, M, P, S, Q, D |
| S | 390 | G, A, V, L, M, W, F, C, Q, R | G, A, V, L, M, W, F, C, Q, R |
| R | 391 | G, A, V, L, M, W, F, C, Y, N, D | G, A, V, L, M, W, F, C, Y, N, D |
| R | 397 | G, A, V, L, I, W, F, S, T, C, Y, K, H | G, A, V, L, I, W, F, S, T, C, Y, K, H |
| D | 398 | G, A, V, L, I, M, W, F, P, S, T, C, Y,E, K, R, H | G, A, V, L, I, M, W, F, P, S, T, C, Y,E, K, R, H |
| R | 399 | G, A, V, L, I, M, W, F, S, T, Y, D, K, H | G, A, V, L, I, M, W, F, S, T, Y, D, K, H |
| E | 403 | G, L, T, C, K, R | G, L, T, C, K, R |
| R | 405 | G, L, Y | G, L, Y |
| E | 407 | G, W | G, W |
| D | 411 | G, C | G, C |
| E | 421 | G, A, V, L, I, M, F, P, S, T, C, Y, Q, D, K, R | G, A, V, L, I, M, F, P, S, T, C, Y, Q, D, K, R |
| D | 422 | G, L, F, S, C, Y, N, R | G, L, F, S, C, Y, N, R |
| R | 427 | L, F, Q | L, F, Q |
| K | 428 | M, F, H | M, F, H |
| E | 432 | G, A, V, L, I, M, W, F, P, S, T, Y, Q, D, K, R | G, A, V, L, I, M, W, F, P, S, T, Y, Q, D, K, R |
| R | 438 | I | I |
| R | 449 | G, A, L, M, W, F, S, T, C, Q, D, E, K | G, A, L, M, W, F, S, T, C, Q, D, E, K |
| R | 456 | G, A, V, L, M, F, S, C, N, D, E, K | G, A, V, L, M, F, S, C, N, D, E, K |
| E | 457 | G, V, L, I, W, F, S, C, Y, N, D, K, R | G, V, L, I, W, F, S, C, Y, N, D, K, R |
| D | 458 | G, A, V, L, I, M, F, P, S, T, Y, N, Q, E, R, H | G, A, V, L, I, M, F, P, S, T, Y, N, Q, E, R, H |
| R | 463 | A, V, L, W, F, P, S, T, C, Y, N, D, E, H | A, V, L, W, F, P, S, T, C, Y, N, D, E, H |
| R | 471 | G, V, L, M, W, F, S, C, N, E | G, V, L, M, W, F, S, C, N, E |
| I | 484 | G, A, V, L, M, W, F, S, C, Y, Q, D, E, K, R | G, A, V, L, M, W, F, S, Y, Q, E, K, R |

The above description of various illustrated embodiments of the disclosure is not intended to be exhaustive or to limit the scope to the precise form disclosed. While specific embodiments of and examples are described herein for illustrative purposes, various equivalent modifications are possible within the scope of the disclosure, as those skilled in the relevant art will recognize. The teachings provided herein can be applied to other purposes, other than the examples described above. Numerous modifications and variations are possible in light of the above teachings and, therefore, are within the scope of the appended claims.

These and other changes may be made in light of the above detailed description. In general, in the following claims, the terms used should not be construed to limit the scope to the specific embodiments disclosed in the specification and the claims.

The entire disclosure of each document cited (including patents, patent applications, journal articles, abstracts, manuals, books or other disclosures) in the Background, Detailed Description, and Examples is herein incorporated by reference in their entireties.

Efforts have been made to ensure accuracy with respect to the numbers used (e.g. amounts, temperature, concentrations, etc.) but some experimental errors and deviations should be allowed for. Unless otherwise indicated, parts are parts by weight, molecular weight is average molecular weight; temperature is in degrees centigrade; and pressure is at or near atmospheric.

SEQUENCE LISTING (496 sequences)

SEQ ID NO: 1 - protein, 526 aa, Pteris albolineata
MDSDLIAQPPDDNAASVGAPAAEKVQEDQLVVTTPEMEDSDVDPQFEQEMINISALIAAGAVEGHDDVDLFAKYMQVEAHDWQNRLRQAILGLTLAIPNPIVGLAISGFIRLLWPANKVSIWEALNAEQYITNIVQQELMQFEMRTLQSRIEALQTTIHRYDQAAATTEKGNFLSNWITQADGLLSSMRNSSNRIHLLLHIVTVAALHMAALHERLTFGEELYGLNDTASWQRALVEMFEEYTIKLIPTIFKEWRPWRERQIEINEWRQRGQSGVTIFRPDSSHATVQDKLSGELFTFRVNYQYSTTIFSGVTRDHRTRMINEAIADMASCISPTFALHMLLPDDVKTRFSPYDRGLFGRVSRGPYSQDLLQQLFTSVKDFRSHPRRFDQTARDRVVKVIIRAGHHVDAIQFWYDHVNSNSTTTGIMAGNSSGGIRHEIDVKDRPIHELRMEFSHNVLASLQLHFQDGTATQKFGNVNGWASRIATCTAPYSYKLSSWAFREDPGPYNTTAISVLRFDFTPEDPSS

SEQ ID NO: 2 - protein, 527 aa, Pteris albolineata
MDSDLIAEPHDGNAASVGAPAAEKVQEDQLVAVTTPEMEDSDVDPQFEQEMINISALIAAGAVEGHDDLDLFAKYMQVDAHDWHNRLRQAILGLTLAIPNPVVGLAISGFIRLIWPPNKVSIWDALNAEQYITNIVQQELMQSEMRTLQSRIEALQTTIYRYDQAAATTEKGTFLSIWISQADGLLSSMRNSSNRIHLLLHIVTVAVLHMAALHERLTFGEELYGLNDTASWKRALVEMFEEYTIKLIPTIFKEWRPWRERQIEINEWRQRGQSGVTIFRPDSSHATVQDKLSGELFTFRVNYQYSTTIFSGVTRDHRTRMINEAIADMASCISPTFALHMLLPDDVKTRFSPYDKELFGRVRRGPYSQDLLQQLFTSVKDFRSHPRRFDQTARDRVVKVIIRAGHHVDAIQFWYDHVNSNSTTTGIMAGNSSGGIRHEIDVKDRPIHELRMEFSHNVLASLQLHFQDGTATQKFGNVNGWASRIATCTAPYSYKLSSWAFREDPGPYNTTAISVLRFDFTPEDPSS

SEQ ID NO: 3 - protein, 526 aa, Pteris albolineata
MDSDLIAQPPDDNAASVGAPAAEKVQEDQLVVTTPEMEDSDVDPQFEQEMINISALIAAGAVEGHDDLDLFAKYMQVDAHDWHNRLRQAILGLTLAIPNPVVGLAISGFIRLIWPPNKVSIWDALNAEQYITNIVQQELMQSEMRTLQSRIEALQTTIYRYDQAAATTEKGTFLSIWISQADGLLSSMRNSSNRIHLLLHIVTVAVLHMAALHERLTFGEELYGLNDTASWKRALVEMFEEYTIKLIPTIFKEWRPWRERQIEINEWRQRGQSGVTIFRPDSSHATVQDKLSGELFTFRVNYQYSTTIFSGVTRDHRTRMINEAIADMASCISPTFALHMLLPDDVKTRFSPYDKELFGRVRRGPYSQDLLQQLFTSVKDFRSHPRRFDQTDRDKVMQVIIRAQHHVDAIQFWYTRANLNSISPGIMAGNYSGGIRYDINVRDRPIQELRMEFSRDVLASLQLHFQDGTATQKFGNVNGWATRIATCTAPYSYKLSSWAFREDPGPNGTTAISVLRFDFTPEDPSS

SEQ ID NO: 4 - protein, 527 aa, Pteris albolineata
MDSDLIAEPHDGNAASVGAPAAEKVQEDQLVAVTTPEMEDSDVDPQFEQEMINISALIAAGAVEGHDDLDLFAKYMQVDAHDWHNRLRQAILGLTLAIPNPVVGLAISGFIRLIWPPNKVSIWDALNAEQYITNIVQQELMQSEMRTLQSRIEALQTTIYRYDQAAATTEKGTFLSIWISQADGLLSSMRNSSNRIHLLLHIVTVAVLHMAALHERLTFGEELYGLNDTASWKRALVEMFEEYTIKLIPTIFKEWRPWRERQIEINEWRQRGQSGVTIFRPDSSHATVQDKLSGELFTFRVNYQYSTTIFSGVTRDHRTRMINEAIADMASCISPTFALHMLLPDDVKTRFSPYDKELFGRVRRGPYSQDLLQQLFTSVKDFRSHPRRFDQTDRDKVMQVIIRAQHHVDAIQFWYTRANLNSISPGIMAGNYSGGIRYDINVRDRPIQELRMEFSRDVLASLQLHFQDGTATQKFGNVNGWATRIATCTAPYSYKLSSWAFREDPGPNGTTAISVLRFDFTPEDPSS

SEQ ID NO: 5 - protein, 526 aa, Pteris umbrosa
MDSDLIAQPHDDNAASVGAPAAEKVHEDQLVVTTPEMEDSDVDPQFEQEMINISALIAAGAVEGHDDVDLFAKYMQVEAHDWQNRLRQAILGLTLAIPNPIVGLAISGFIRLLWPANKVSIWEALNAEQYITNIVQQELMQFEMRTLQSRIEALQTTIHRYDQAAATTEKGNFLSNWISQADGLLSSMRNSSNRIHLLLHIVTVAVLHMAALHERLTFGEELYGLNDTASWKRALVEMFEEYTIKLIPTIFKEWRPWRERQIEINEWRQRGQSGINTHRPNSSHATVQDKLSGELFTFRVNYQYSTTIFSRVTRDHRIRMINEAIADMASCISPTFALHMLLPDDVKTRFSPYDKQLFSRVSRGPYSQDLLQQLFTNVKDFRSQPIRADQTARDRVVKVIIRARHHVDAIQFWYDHANSNSTTTGIMAGNSSGGIRHEIDVKDRPIQELRMEFSHDVLASLQLHFQDGTATQKFGNVNGWASRIATCTAPYSYKLSSWAFREDPGPNGTTAISVLRFDFTPEDPSS

SEQ ID NO: 6 - protein, 489 aa, Polypodium formosanum
MDSDLIAQPHDDNAASVGAPAAEKVEEEESVVTMPETDQDSDVDPQFEQEMNNISALIAAGAVEGHDDVDLFAKYMQVEAHDWHNRLRQAILGLTLAIPNPIVGLAISGFIRLIWPANKVSIWEALNAEQYIRNIVQQELMQFEMRTLQSQIETLQTTIHRYDQAAAIPEKGNFLSNWISQADGLFSSMRNSSNRIHLLLHIVTVATLHMAALHERLSFGKELYGVDDTASWKRALEQMFEEYTIKLIPTIFKEWRPWRETQIEINEWRQRGQSGVSIFRPDSSHATVQDKLSGELFTFRVNYQYSTTIFSGVTRDHRTRMINEAIADMASCISPTFALHTLLPDDVKTKYSPYDKAIFGRVIIRAQHHVDAIQFLYDHANPNLTTNGLMAGNSSGGIRYQINVRDRPIEELRMEFSRDVLASLQLHFQDGTATQKFGNVNSWATTIATCTAPFGYKLSSWAFREDPGPNGTLAISVLRFDFTPEDPST

SEQ ID NO: 7 - protein, 527 aa, Polypodium formosanum
MDSDLIAQPHDDNAASVGAPAAEKVEEEESVVTMPETDQDSDVDPQFEQEMNNISALIAAGAVEGHDDVDLFAKYMQVEAHDWHNRLRQAILGLTLAIPNPIVGLAISGFIRLIWPANKVSIWEALNAEQYIRNIVQQELMQFEMRTLQSQIETLQTTIHRYDQAAAIPEKGNFLSNWISQADGLFSSMRNSSNRIHLLLHIVTVATLHMAALHERLSFGKELYGVDDTASWKRALEQMFEEYTIKLIPTIFKEWRPWRETQIEINEWRQRGQSGVSIFRPDSSHATVQDKLSGELFTFRVNYQYSTTIFSGVTRDHRTRMINEAIADMASCISPTFALHTLLPDDVKTKYSPYDKAIFGRVSRGPYSQDLRQQLFTIVKDFRSHPRRFDQTARDRVLEVIIRAQHHVDAIQFLYDHANPNLTTNGLMAGNSSGGIRYQINVRDRPIEELRMEFSRDVLASLQLHFQDGTATQKFGNVNSWATTIATCTAPFGYKLSSWAFREDPGPNGTLAISVLRFDFTPEDPST

SEQ ID NO: 8 - protein, 527 aa, Polypodium formosanum
MDSDLIAQPHDDNAASVGAPAAEKVEEEESVVTMPETDQDSDVDPQFEQEMKNISALIAAGAVEGHDDVDLFAKYMQVEAHDWHNRLRQAILGLTLAIPNPIVGLAISGFIRLIWPANKVSIWEALNAEQYIRNIVQQELMQFEMRTLQSQIETLQTTIHRYDQAAAIPEKGNFLSNWISQADGLFSSMRNSSNRIHLLLHIVTVATLHMAALHERLSFGKELYGVDDTASWKRALEQMFEEYTIKLIPTIFKEWRPWRETQIEINEWRQRGQSGVSIFRPDSSHATVQDKLSGELFTFRVNYQYSTTIFSGVTRDHRTRMINEAIADMASCISPTFALHTLLPDDVKTKYSPYDKAIFGRVSRGPYSQDLRQQLFTIVKDFRSHPRRFDQTARDRVLEVIIRAQHHVDAIQFLYDHANPNLTTNGLMAGNSSGGIRYQINVRDRPIEELRMEFSRDVLASLQLHFQDGTATQKFGNVNSWATTIATCTAPFGYKLSSWAFREDPGPNGTLAISVLRFDFTPEDPST

SEQ ID NO: 9 - protein, 521 aa, Nephrolepis obliterata
MAGYNHVQDQLVMQAAEDVNTVSELAPAADQKEQNATGMAEEDPIFAQLAQKMAAAAEKEEAPVDLLAQYMQVEAHDWHNRIRGAILGLISAVPKVGAAISRLIGLFWPSNKVDIWEALNAEEYIRNIVQQELFEFEMQLLQNDIQALEATVGRYDTAALTEKGNFLSIWISQADALYIRMRNSTNNIHLLLHMVTVSTLHLAALHERLTFGEELYGTNNSANWTQDLVDKFERYTTDLIPTVFRRWKEWRPTQIEITTWVRRGSCGNLICRPDVSHATVEDKISGALFSFQATNRNSTTIFSEVCEDHKTRMVNEAIADMASCLSPTFAFHKLLPDDIQTQFSPYDRQQFGQVFRGPYSQDLSHGLWTVFKSFRSRTTRSDQTLRDRILEVIIRAGHHVDAIQFVYDHVNPNSTTPGIVAGNAAGGTRHQIDVRDRPIKEVRMEFSQDVLASLQLHFEDGTSTRKFGNELGWATRILTCTVPYGYRFSSWAFREDPGPYRTTAISVLRFQFTPELDMPLP

SEQ ID NO: 10 - protein, 512 aa, Colysis wrightii
MAAEGVETVSELAPATDKVQNADMAEEDPIFTQLAQKMAAAAEKEEVPVDLLAQYMQVEAHDWHNRVRGAILGLISAVPKVGAAISRLIGLFWPANKVDIWEALRAEEYIRNIVQQELFEFEMRLLENDIQALETTVGRYDTAALTEKGNFLSIWISQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCLSPTFAFHKLLPDDIQTQFSPYDRQQFGQVFRGPYSQDLSHGLWTAFKNFRSRTTRSDQTLRDRILEVIIRAGHHVDAIQFVYDHSNPNLTTPGTVAGNAAGGTRHQVDVRDRPIQELRMEFSQDVLASLQLHFEDGTSTRKFGNELGWATRILTCTAPYGYRFSSWAFREDPGPYRTTAISVLRFQFTPELDMPLPASYMLS

SEQ ID NO: 11 - protein, 510 aa, Nephrolepis exaltata
MAAAEDVNTVSELAPAADQKEQNDATGMAEEDPIFAQLAQKMAAAAEKEEAPVDLLAQYMQVEAHDWHNRIRGAILGLISAVPKVGAAISRLIGLFWPSNKVDIWEALNAEEYIRNIVQQELFEFEMQLLQNDIQALETTVGRYDTAALTEKGNFLSIWISQADALYIRMRNSTNNIHLLLHMVTVSTLHLAALHERLTFGEELYGTNNAANWTQDLVDKFERYTTDLIPNVFRRWKEWRPTQIEITTWVRRGSCGNLTCRPDVSYATVEDKISGALFSFQATNRNSTTIFSEVCEDHKTRMVNEAIADMASCLSPTFAFHKLLPDDIQTQFSPYDRQQFGQVFRGPYSQDLSHGLWTVFKSFRSRTTRSDQTLRDRILEVIIRAGHHVDAIQFVYDHVNPNSTTPGIVAGNAAGGTRHQIDVRDRPIKEVRMEFSQDVLASLQLHFEDGTSTRKFGNELGWATRILTCTVPYGYRFSSWAFREDPGPYRTTAISVLRFQFTPELDMPLP

SEQ ID NO: 12 - protein, 523 aa, Davallia tyermannii
MAGYNHVQDQLVMPAEDVNTPVNTVSELAPAAEKVQNADMAAEEDPIFTQLAQKMAAAAEKEEAPVDLLAQYMQVEAHDWHNRIRGAILGLISAVPKVGAAISRLIGLFWPSNKVDIWEALNLEGYIRNIVQQELFEFELQLLQNDIQALEATVGRYDRAALTEKGNFLSIWISQADALYIRMRNSSNNIHLLLHMVTVSTLHLAALHERLTFGEELYGSNNSANWTHDLVDKFERYTTDLIPNVFKRWKEWRPTQIVITTWVRRGSCGNLICRPDISYATVEDKLSGALFSFQATNRNSTTIFLEVCEDHKTRMMNEAVADMASCLSPTFAFHKLLPNDIQTQFSPYDRQQFGQVFRGPYSADLSHGLWTVFKSFRSRTTRSDQTLRDRILEVIIRAGHHVDAIQFVYDHVNPNSTTPGIVAGNAAGGTRHQVDVRDRPIQELRMEFSQDVLASLQLHFEDGTSTRKFGNELGWATRILTCTAPYGYRLSSWAFREDPGPYRTTAISVLRFQFTPELDMPLP

SEQ ID NO: 13 - protein, 526 aa, Pyrrosia lanceolata
MAGYNHVQDQLVMAADQDVNTVSELAPATDKVQNEDMVEEDPIFAQLAEKMAAAAEKGEAPVDLLAQYMQVEAHDWHNRIRGAILGLISLVPKVGAAVSRLIGLFWPANKVDIWEALKAEEYIRNIVQQELFEFEMRLLQDDIEALEMTVARYDRAALTEKGNFLSIWISQADALYIRMRNSTNNIHLLLHMVTVSTLHMAALHERLTFGEELYGTNNSANWTQDLVDKFERYTADLIPSVFKRWKEWRPTQIEIRAWINRGSCGNLTCRPNVSHATVEDKTSGARFSFQSSGSSSTTMFSEICEDHKTRMVNEAIADMASCLSPTFAFHKLLPDDIQAQFSPYDRQEFGQVFRGPYSQDLSHGAWTNFKNFRSRTTRSDQTLRDRILEVIIRAGSHVDALQFIYDHVNPNSMTPGIMAGNAAGGVRHQVDVRDRPIQEVRMEFARDVLASLQLHFEDGTSTQKFGNELFGTWATRILTCTAPYGYRFSSWAFREDPGPYRTTAISVLRFQFTPELDMPLPSEYLI

SEQ ID NO: 14 - protein, 526 aa, Pyrrosia lanceolata
MAGYNHVQDQLVMAADQDVNTVSELAPATDKVQNEDMVEEDPIFAQLAEKMAAAAEKGEAPVDLLAQYMQVEAHDWHNRIRGAILGLISLVPKVGAAVSRLIGLFWPANKVDIWEALKAEEYIRNIVQQELFEFEMRLLQDDIEALEMTVARYDRAALTEKGNFLSIWISQADALYIRMRNSTNNIHLLLHMVTVSTLHMAALHERLTFGEELYGTNNSANWTQDLVDKFERYTADLIPSVFKRWKEWRPTQIEIRAWINRGSCGNLTCRPNVSHATVEDKTSGARFSFQSSGSSSTTMFSEICEDHKIRMVNEAIADMASCLSPTFAFHKLLPDDIQAQFSPYDRQEFGQVFRGPYSQDLSHGAWTNFKNFRSRTTRSDQTLRDRILEVIIRAGSHVDALQFIYDHVNPNSMTPGIMAGNAAGGVRHQVDVRDRPIQEVRMEFARDVLASLQLHFEDGTSTQKFGNELFGTWATRILTCTAPYGYRFSSWAFREDPGPYRTTAISVLRFQFTPELDMPLPSEYLI

SEQ ID NO: 15 - protein, 523 aa, Pyrrosia lanceolata
MAGYNHVQDQLVMAADQDVNTVSELAPATDKEDMVEEDPIFAQLAEKMAAAAEKGEAPVDLLAQYMQVEAHDWHNRIRGAILGLISLVPKVGAAVSRLIGLFWPANKVDIWEALKAEEYIRNIVQQELFEFEMRLLQDDIEALEMTVARYDRAALTEKGNFLSIWISQADALYIRMRNSTNNIHLLLHMVTVSTLHMAALHERLTFGEELYGTNNSANWTQDLVDKFERYTADLIPSVFKRWKEWRPTQIEIRAWINRGSCGNLTCRPNVSHATVEDKTSGARFSFQSSGSSSTTMFSEICEDHKTRMVNEAIADMASCLSPTFAFHKLLPDDIQAQFSPYDRQEFGQVFRGPYSQDLSHGAWTNFKNFRSRTTRSDQTLRDRILEVIIRAGSHVDALQFMYDHVNPNSTTPGVMAGNAAGGVRHQVDVRDRPIQEVRMEFARDVLASLQLHFEDGTSTQKFGNELFGTWATRILTCTAPYGYRFSSWAFREDPGPYRTTAISVLRFQFTPELDMPLPSEYLI

SEQ ID NO: 16 - protein, 509 aa, Tectaria milnei
MAAKDVNTVSELAPAADQKEQNDATGMAEEDPIFAQLAQKMAAAAEKEEAPVDLLAQYMQVEAHDWHNRIRGAILGLISAVPKVGAAISRLIGLFWPSNKVDIWEALNAEEYIRNIVQQELFEFEMQLLQNDIQALETTVGRYDTAALTEKGNFLSIWISQADALYIRMRNSTNNIHLLLHMVTVSTLHLAALHERLTFGEELYGTNNAANWTQDLVDKFERYTTDLIPNVFRRWKEWRPTQIEITTWVRRGSCGNLTCRPDVSYATVEDKISGALFSFQATNRNSTTIFSEVCEDHKTRMVNEAIADMASCLSPTFAFHKLLPDDIQTQFSPYDRQQFGQVFRGPYSQDLSHGLWTVFKSFRSRTTRSDQTLRDRILEVIIRAGHHVDAIQFVYDHVNPNSTTPGIVAGNAAGGTRHQIDVRDRPIKEVRMEFSQDVLASLQLHFEDGTSTRKFGNELGWATRILTCTVPYGYRFSSWAFREDPGPYRTTAISVLRFQFTPELDFPLS

SEQ ID NO: 17 - protein, 513 aa, Polystichum proliferum
MAAEDVNTVSELAPAADEVQNADMAVEEDPIFSQLAQKMVAAAAAAEGEEVPVDLLAQYMQVEAHDWHNRIRGAVLGLISAVPKVGAAISRLIGLFWPSNKVDIWEALNAEEYIRNIVQQELFQFEMQLLRNDIEALETTVGRYDTAALTEKGNFLSIWITQADALYIRMRNSTNNIHLLLHMVTVSTLHLAALHERLTFGEELYGTNNSANWTQDLVDKFELYTTDLIPSVFKRWKDWRPTQIEITAWVQRGSCGNLTCRPNVSYARVEDKISGAIFSFQATNRNSTTIFSGICEDHKTRMVNEAIADMASCLSPTFAFHKLLPDHIQPRFSAFDREQFGQVFRGPYSHDLSHGAWTALKSFRSHTTRSDQTNRDRILEVIIRAGSHVDAIQFMYDHANPNAMTAGIMAGNSAGGQRYWVDVRGRPIQELRMAFARDVLASLQLHFEDGTSTPRFGDDVGWASRILTCTAPYGYRFSSWAFREDPGPYGSTAISVLRFQFTPELDIPLPAHI

SEQ ID NO: 18 - protein, 513 aa, Polystichum proliferum
MAAEDVNTVSELAPAADEVQNADMAVEEDPIFSQLAQKMVAAAAAAEGEEVPVDLLAQYMQVEAHDWHNRIRGAVLGLISAVPKVGAAISRLIGLFWPSNKVDIWEALNAEEYIRNIVQQELFQFEMQLLRNDIEALETTVGRYDTAALTEKGNFLSIWITQADALYIRMRNSTNNIHLLLHMVTVSTLHLAALHERLTFGEELYGTNNSANWTQDLVDKFELYTTDLIPSVFKRWKDWRPTQIEITAWVQRGSCGNLTCRPNVSYARVEDKISGAIFSFQATNRNSTTIFSGICEDHKTRMVNEAIADMASCLSPTFAFHKLLPDHIQPRFSAFDREQFGQVFRGPYSQDLSHGAWTALKSFRSHTTRSDQTNRDRILEVIIRAGSHVDAIQFMYDHANPNAMTAGIMAGNSAGGHRYWVDVRGRPIQELRMAFARDVLASLQLHFEDGTSTPRFGDDVGWASRILTCTAPYGYRFSSWAFREDPGPYGSTAISVLRFQFTPELDIPLPAHI

SEQ ID NO: 19 - protein, 513 aa, Polystichum proliferum
MAAEDVNTVSELAPAADEVQNADMAVEEDPIFSQLAQKMVAAAAAAEGEEVPVDLLAQYMQVEAHDWHNRIRGAVLGLISAVPKVGAAISRLIGLFWPSNKVDIWEALNAEEYIRNIVQQELFQFEMQLLRNDIEALETTVGRYDTAALTEKGNFLSIWITQADALYIRMRNSTNNIHLLLHMVTVSTLHLAALHERLTFGEELYGTNNSANWTQDLVDKFELYTTDLIPSVFKRWKDWRPTQIEITAWVQRGSCGNLTCRPNVSYARVEDKISGAIFSFQATNRNSTTIFSGICEDHKTRMVNEAIADMASCLSPTFAFHKLLPDHIQPRFSAFDREQFGQVFRGPYSHDLSHGAWTALKSFRSHTTRSDQTNRDRILEVIIRAGSHVDAIQFMYDHANPNAMTAGIMAGNSAGGHRYWVDVRGRPIQELRMAFARDVLASLQLHFEDGTSTPRFGDDVGWASRILTCTAPYGYRFSSWAFREDPGPYGSTAISVLRFQFTPELDIPLPAHI

SEQ ID NO: 20 - protein, 510 aa, Polystichum acrostichoides
MAAEHDVNSVVAAPAEEVQKDADCMEEEDPVFSQLAQKMVAAAAAEGLQENPVDLLAKYMQVEAHDWHNRIRGAVLGLLSAVPKVGAAISMLIGLFWPANRVDIWEAINAEEYIRNIVQQEIFEFELQLLRSDIEALETTIGHYDTAALTERGGFLSIWITQASALHIRMRNSAQNIHLLLHIVTVSTLHIAALHERLIFGQELYGSSNTAGWTRDLVNAFEMYTTDLIPNVFKRWKEWRENQIEIRAWVVRGSCGNLICRPNISHATVEDKVSGERFSFQATNRNSTTIFSGICEDHKIRMGNEAIADMASCLSPTFAFHKLLPDDIQTQFSPYDREQFGRVFRGPYSQDLSHGHWTAVKSFRSHPTRFDQTARDRILQVIIRAGSHVDAIQFWYDHVNSNAMTAGTMAGNPLGGNRHEVDVRNRPIQELRMEFARDVLASLQLRFEDGTSTPEFGNDGWATRILTCTAPYGYRLSSWAFREDPGPYQTTAISVLRFQFTPEDIIIPPN

SEQ ID NO: 21 - protein, 527 aa, Pyrrosia rupestris
MAGYNHVQDQLVMAADQDVNTVSELAPATDKVQNGDMVEEDPIFAQLAQKMAAAAEKGEAPVDLLAQYMQVEAHDWHNRIRGAILGLISAVPKVGAAISRLIGLFWPANRVDIWEALRAEEYIRNIVQQELFEFEMRLLQNDIEALEMTVGRYDTAALTEKGNFLSIWISQADALYIRMRNSTNNIHLLLHMVTVSTLHMAALHERLTFGEELYGSNNSANWTADLVDKFERYTTDLIPSVFKRWKEWRPTQIEIRAWIHRGSCGNLTCRPNVSHATVEDKISGALFSFQSTGSSSTTMFSEVCEDHKTRMVNEAIADMASCLSPTFAFHKLLPDDIQAQFSPYDRQEFGQVFRGPYSQDLSHGLWTSFKNFRSRTTRSDQTLRDRILEVIIRAGSHVDAIQFVYDHANPNSTTLGTLAGNATGGNRHQVDVRDPPIQELRMEFARDVLASLQLHFEDGTSTQKFGNVLFGTWATRILTCTAPYGYRFSSWAFREDPGPYGTTAISVLRFQFTPELDMPLPASYMIL

SEQ ID NO: 22 - protein, 524 aa, Pyrrosia rupestris
MAGYNHVQDQLVMAADQDVNTVSELAPATDKGDMVEEDPIFAQLAQKMAAAAEKGEAPVDLLAQYMQVEAHDWHNRIRGAILGLISAVPKVGAAISRLIGLFWPANRVDIWEALRAEEYIRNIVQQELFEFEMRLLQNDIEALEMTVGRYDTAALTEKGNFLSIWISQADALYIRMRNSTNNIHLLLHMVTVSTLHMAALHERLTFGEELYGSNNSANWTADLVDKFERYTTDLIPSVFKRWKEWRPTQIEIRAWIHRGSCGNLTCRPNVSHATVEDKISGALFSFQSTGSSSTTMFSEVCEDHKTRMVNEAIADMASCLSPTFAFHKLLPDDIQAQFSPYDRQEFGQVFRGPYSQDLSHGLWTSFKNFRSRTTRSDQTLRDRILEVIIRAGSHVDAIQFVYDHANPNSTTLGTLAGNATGGNRHQVDVRDPPIQELRMEFARDVLASLQLHFEDGTSTQKFGNVLFGTWATRILTCTAPYGYRFSSWAFREDPGPYGTTAISVLRFQFTPELDMPLPASYMIL

SEQ ID NO: 23 - protein, 522 aa, Asplenium antiquum
MAGYNHVQDQQLVMAAEGVETVSELAPATDKVQNADMAEEDPIFAQLAQKMAAAAEEEEVPVDLLAQYMQVEAHDWHNRVRGAILGLISAVPKVGAAISRLIGLFWPANKVDIWEALKLEEYIGNIVQQELFEFELRLLENDIQALETTVGRYDTAAALTEKGNFLSIWISQADALYIRMRNSTNNIQLLLHMVTVSTLHLAALHERLTIGEELYGSNNSANWTQDLVDKFERYTADLIPNVFKRWKEWRPTQIEIRAWVRRGSCGVVTCRPDVSFATVEDKISGALFSFQAANRNSTTIFLEVCEDHKTRMVNEAIADMASCLSPTFAFHKLLPDDIQAQFSPYDRQQFGQVFRGPYSQDLSHGLWTVFKSFRSRTTRSDQTRRDRILEVIIRAGHHVDAIQFMYDHANPNLTTPGTVAGNAAGGSRHQVDVRNRPIQEVRMEFSQDVLASLQLHFEDGTSTRKFGNELGWATRILTCTAPYGYRFSSWAFREDPGPYRTTAISVLRFQFTPELDMPLPNI

SEQ ID NO: 24 - protein, 524 aa, Doryopteris cordata
MAAEGVKYTGSELATPAAEEMQKNVLAPAAMDMQEAEEDPIFAQLAQEMQLAAAKGQDIPVVDLIEKYMQVQAHDWHNRIRGAILGLISLVPTVGRAVSRLIGLFWPANRVDIWEALKLEQYIRNIVQQEIFDFEMQLLRSDIEALETTVARYDMAALNEKGNFLSIWISQADALYFRMRNSTNNIHLLLHIVTVSTLHLAALHERLTFGEELYGTNNAANWTQDLVNMFRLYTVDLIPSIFKRWKEWREAQIEIRAWVNRGSCGNLICRPNVSHATVEDKISGARVTFQATNQNSTTIFSAICEDHKTRMVNEAVADMASCLSPTFAFHKLLPDNIQAQFSAYDREQFGRVFRGPYSQDLSHGAWTSLKSFRSRPTRFDQTARDRILEVIIRAGSHIDAIQFWYDHANANSMTAGVMAGNPSGGSRYQVDVRGRLIQDLRMEFSRDVLAALQLRFIDGISTQNFGNANGGITRDVTCTAPYGYRLSSWAFREDTGPYGTAAISVLRFQFTPELDFPVPEEYSV

SEQ ID NO: 25 - protein, 498 aa, Asplenium ebenoides
MAAPGMKDSEVIADVVTTPVSAVPDEEVQELDKLGLQEVADNIDVLAKYMQTEAHDWHNRTRGAVLGIISAIPKVGAAISMLIGLFWPANKVDIWVALNAEEYVRNIVRQEIFEFEMQQHKSEIEALEAAISRYDTAALTEKGNFLSIWIWQADRLCIQLRNSANRIHLLLHIVTVAVLHIAAMHERFTFGEEIYGTNNTAAWRKDFVDVFEMYTSNIVPNLFKEWRQWRESQIEIKAWVVRGVWGNITSTPDVSHATVEDKISGEKFAFRVARRNSTTIFSAICEDHKTRMLNEAIADMAACLSPTFAFHKLLPNDTQMQLSPYDKELFGQVFRGPYSHDLLQPLFTALKSFRSRPTRFDQTARDKILEVTIRAGHHVDAIQFWYDHVNSNAMTAGIVAGNSAGGSRHQVDVRNRRIQDLRLEFSRDVLASLQLHFEDGTSTRKFGNEAGWATNIVTCTTPSGYRLSSWAFREDPGPYNTTAISVLRFQFTPEDPSS

SEQ ID NO: 26 - protein, 498 aa, Asplenium ebenoides
MAAPGMKDSEVIADVVTTPVSAVPDEEVQELDKLGLQEVADNIDVLAKYMQTEAHDWHNRTRGAVLGIISAIPKVGAAISMLIGLFWPANKVDIWVALNAEEYVRNIVRQEIFEFEMQQHKSEIEALEAAISRYDTVALTEKGNFLSIWIWQADRLCIQLRNSANRIHLLLHIVTVAVLHIAAMHERFTFGEEIYGTNNTAAWRKDFVDVFEMYTSNIVPNLFKEWRQWRESQIEIKAWVVRGVWGNITSTPDVSHATVEDKISGEKFAFRVARRNSTTIFSAICEDHKTRMLNEAIADMAACLSPTFAFHKLLPNDTQMQLSPYDKELFGQVFRGPYSHDLLQPLFTALKSFRSRPTRFDQTARDKILEVTIRAGHHVDAIQFWYDHVNSNAMTAGIVAGNSAGGSRHQVDVRNRRIQDLRLEFSRDVLASLQLHFEDGTSTRKFGNEAGWATNIVTCTTPSGYRLSSWAFREDPGPYNTTAISVLRFQFTPEDPSS

SEQ ID NO: 27 - protein, 540 aa, Adiantum venustum
MISTYFDGKFIFGLILIMAGYQVQDQLAVMAAENVNSVVALPVEKVQLDGADMEEDPIFAKLAQEMVAAAAAEGRQEVPVDLLARYMQVEAHDWHNRIRGAVLGLISVVPKVGAAISRLIGLFWPANKVDIWEAIKAEEYIRNIVQQEIFEFEMQQLRNDIEALETTVARYNTAVLNEKGNFLSIWISQADALFIRMRNSPNRIHLLLHIVTVSTLHVAALHERMTFGEELYGSNNTANWTQDLVTVFERYTTDLIPNVFKSWKEWRETQIEITAWVRRGTCGNLMCRPDVSFAQVEDKVSGAIFSFQATNRNSTTIFLGVCQDHKIRMTNEATADMASCLSPTFAFHKLLPDHIQTQFSPYDREQFGRVFRGPYSQDLSHGFWTVLKAFRSHPTRFDQTARDRILEMTIRAGSHVDAIQFWYDHVNSNSMTPGIMAGNSMGGIRHQVDVRGRPIQEIRMEFARDVLASLQLHFEDGTSTPEFGNDGWATRILTCTAPYGYRFSSWAFREDPGPYGTTAISVLRFQFTPEDVIIPPDEQL

SEQ ID NO: 28 - protein, 523 aa, Adiantum venustum
MAGYQVQDQLAVMAAENVNSVVALPVEKVQLDGADMEEDPIFAKLAQEMVAAAAAEGRQEVPVDLLARYMQVEAHDWHNRIRGAVLGLISVVPKVGAAISRLIGLFWPANKVDIWEAIKAEEYIRNIVQQEIFEFEMQQLRNDIEALETTVARYNTAVLNEKGNFLSIWISQADALFIRMRNSPNRIHLLLHIVTVSTLHVAALHERMTFGEELYGSNNTANWTQDLVTVFERYTTDLIPNVFKSWKEWRETQIEITAWVRRGTCGNLMCRPDVSFAQVEDKVSGAIFSFQATNRNSTTIFLGVCQDHKIRMTNEATADMASCLSPTFAFHKLLPDHIQTQFSPYDREQFGRVFRGPYSQDLSHGFWTVLKAFRSHPTRFDQTARDRILEMTIRAGSHVDAIQFWYDHVNSNSMTPGIMAGNSMGGIRHQVDVRGRPIQEIRMEFARDVLASLQLHFEDGTSTPEFGNDGWATRILTCTAPYGYRFSSWAFREDPGPYGTTAISVLRFQFTPEDVIIPPDEQL

SEQ ID NO: 29 - protein, 540 aa, Arachniodes standishii
MAAPGMMDSEVIAEDVNTVSVLAPAAKKVQDDQFVTTEPDSVYLQLAQEMIDDVVNIVSAPVAAGAEEGQKVTVDLLAKYVLLGAHDWNNRIREVILGLASLIPKVGGGVRLLISIFWPAHKVDIWQAINGEQYVRNIVRQEIFEFELQQYRSDIEALQTTILRYDTAAPIIEKGNFLSIWISQADKLCVRLRNSPNNIHLLLHIVTVAALHVAAMHERLTFGKELYGSDNTANWKQDLVDVFQMYTSNLIPNLFRNWKQWRESQIEIKAWVVPGRWGNLVMTTPDVSHATVEDKISGEKFTFRVVRRNSTTIFSGVCQDHKTRMGNEAIADMASCISPTFAFHELLPDDIQAQFSPYDKELFGQVFRGPYSQDLLQRSFTGLKDFRSRPTRFDQTTQDRIWEVIIRAGHHVDAIQFWYENANPYAMTAGTMAGNSAGGISHRVNVMNRPIEELRMEFSHDVLASMQLHFKDDTSTQKFGNQLGWASNIVTCTAPSGYRLSSWAFREDPGPYSTTAISILRFQFTPYENQEMRSPMAVGG

SEQ ID NO: 30 - protein, 536 aa, Adiantum venustum
MISTYFDGKFIFGLILIMAGYQVQDQLAVMAAENVNSVVALPVEKGADMEEDPIFAKLAQEMVAAAAAEGRQEVPVDLLARYMQVEAHDWHNRIRGAVLGLISVVPKVGAAISRLIGLFWPANKVDIWEAIKAEEYIRNIVQQEIFEFEMQQLRNDIEALETTVARYNTAVLNEKGNFLSIWISQADALFIRMRNSPNRIHLLLHIVTVSTLHVAALHERMTFGEELYGSNNTANWTQDLVTVFERYTTDLIPNVFKSWKEWRETQIEITAWVRRGTCGNLMCRPDVSFAQVEDKVSGAIFSFQATNRNSTTIFLGVCQDHKIRMTNEATADMASCLSPTFAFHKLLPDHIQTQFSPYDREQFGRVFRGPYSQDLSHGFWTVLKAFRSHPTRFDQTARDRILEMTIRAGSHVDAIQFWYDHVNSNSMTPGIMAGNSMGGIRHQVDVRGRPIQEIRMEFARDVLASLQLHFEDGTSTPEFGNDGWATRILTCTAPYGYRFSSWAFREDPGPYGTTAISVLRFQFTPEDVIIPPDEQL

SEQ ID NO: 31 - protein, 527 aa, Blechnum medium
MAALDHTKDSEIIAGRAVATDHDPATVVSEEDSETKIAEVACDPATAGDPAGEVHELDKLALECGSDGIDLLAKRMQVDAHDWHNRLRGAVLGLLSDLPLGGAISTLVGLFWPATRVNIWEALGMEAYVTNIVRKEIFEFEMRQHESDIEALERSILRYERGLLTEKATALGIWIAQADALSIRLGNSTNRIHLLLHIVTVAVLHMAALHERLTFGEEIYGANNTANWTKELEETFQRYTSDRIPVIFKEWRPWRESQIEIRAWRRRASGMVIFNPDASFATVEDKISGAIFNFSVNYHYSMSIFSDICEAHKARMMNEANADMASCMSPTFAFHKLLPGDSQSKFSPYDRQLFGQVFRGPFSQDLLQPRFTSLKTFRMHPTRSDIMLGTRVLQVNVRAGTLLESIQFVYYHPSSPNGIPNWGNIAGNPRGGESFVVDVRTRHIQDLRLEFSRDVLVSLQIRFEDGTSTQKFGNATGWATSAVTCTAPSGYTLNSWDFREDPGPNGTTAISVAGYGFTPDDIRLPPA

SEQ ID NO: 32 - protein, 512 aa, Dryopteris intermedia
MALARPAMMHSEMIAEGVNNSAPLAEDDIQQLQDSVYTQLAQQMIADAHHEEGGQEVDLLAKYMQTEAHDWHNRTRGAILGLLSAIPKVGAGISMLVGLFWPANRVSVWEAINGEKYVKNIVRQELFEFEMNQHRSEIQALETTVSRYNTAGGLTERGNFLSIWITQADRVSFLLQNSTNNIHLLLHIVTVAVLHVAALHERLTFGEELYGQANTAQWTQDLVDVFEMYTSKVVPNVFNKWKQWRESQIEIRAWTVSASWGNLTGRPSSSHATVEDKISGEIFTFRVTNRQSTTIFSEVCQDHKTRMVNEATADMASCLSPTFAFHKLLPDDVQARFSPYDQGLFGRVFRGPYSQDLLQGLFTTLKAFRSRATRFDQTTRDRVLEVVIRAGSHVDAIQFWYDHSNPNAVTQGIMAGHPAGGNRHQVNVRDRPIQELRMGFARDVLAWLQLHLEDGTSTQQFGSTGWASNIVTCTAPYGYRLSSWAFRQDPGPYSTPAISVLRFQFTPDDIRV

SEQ ID NO: 33 - protein, 512 aa, Dryopteris intermedia
MALARPAMMHSEMIAEGVNNSAPLAEDDIQQLQDSVYTQLAQQMIADAHHEEGGQEVDLLAKYMQTEAHDWHNRTRGAILGLLSAIPKVGAGISMLVGLFWPANRVSVWEAINGEKYVKNIVRQDLFEFEMNQHRSEIQALETTVSRYNTAGGLTERGNFLSIWITQADRVSFLLQNSTNNIHLLLHIVTVAVLHVAALHERLTFGEELYGQANTAQWTQDLVDVFEMYTSKVVPNVFNKWKQWRESQIEIRAWTVSASWGNLTGRPSSSHATVEDKISGEIFTFRVTNRQSTTIFSEVCQDHKTRMVNEATADMASCLSPTFAFHKLLPDDVQARFSPYDQGLFGRVFRGPYSQDLLQGLFTTLKAFRSRATRFDQTTRDRVLEVVIRAGSHVDAIQFWYDHSNPNAVTQGIMAGHPAGGNRHQVNVRDRPIQELRMGFARDVLAWLQLHLEDGTSTQQFGSTGWASNIVTCTAPYGYRLSSWAFRQDPGPYSTPAISVLRFQFTPDDIRV

SEQ ID NO: 34 - protein, 512 aa, Dryopteris intermedia
MALARPAMMHSAEGVNNSAPPPAEDDIQLQLQDSVYTQLAQQMIADAHDHEEGGQEVDLLAKYMQTEAHDWHNRTRGAILGLLRAIPKVGAGISMLVGLFWPANKVSVWEAINGEKYVKNIVRQELFEFEMNQHRSEIQALETTVSRYNTAGGLTERGNFLSIWITQADRVSFLLQNSTNNIHLLLHIVTVAVLHVAALHERLTFGEELYGQANTAQWTQDLVDVFEMYTSKVVPNVFNKWKQWRESQIEIRAWTVSASWGNLTGRPSSSHATVEDKISGEIFTFRVTNRQSTTIFSEVCQDHKTRMVNEATADMASCLSPTFAFHKLLPDDVQARFSPYDQGLFGRVFRGPYSQDLLQGLFTTLKAFRSRATRFDQTTRDRVLEVVIRAGSHVDAIQFWYDHSNPNAVTQGIMAGHPAGGNRHQVNVRERPIQELRMGFARDVLAWLQLHLEDGTSTQQFGSTGWASNIVTCTAPYGYRLSSWAFREDPGPYSTPAISVLRFQFTPDDIRV

SEQ ID NO: 35 - protein, 523 aa, Ophioglossum pendulum
MLSSGVYVSLEDQQLVMAAQGVETLSQLAPATDKVQNSDMAEEDPIFTQLAKKMAVAAEKEEVPVDLLAQYMQVEAHDWHNRVRGAILGLISAVPKVGAAISRLIGLFWPANKVDIWEALKLEEYIRNIVQQELFEFELRLLENDIQALETTVGRYDMAALTEKGNFLSIWISQADALYIRMRNSTNNIHLLLHMVTVSTLHLAALHERLTFGEELYGTNNSVNWTQDLVEKFERYTADLIPNVFKRWKEWRPTQIEIRAWVRRGSCGNLVCRPDVSYATVEDKISGALFSFQATNRNSTTIFLEVCEDHKTRMVNEAIADMASCLSPTFAFHKLLPDNIQAQFSPYDRQQFGQVLRGPYSQDLSHGLWTVFKSFRSRTTRSDQTLRDRILEVIIRAGHHVDAIQFVYDHANPNLTTPGTVAGNAAGGNTHQVDVRDRPIQEVRMEFSQDVLASLQLHFEDGTSTRKFGDELGWATRILTCTAPYGYRFSSWAFREDPGPYRTTAISVLRFQFTPELDMPLPI

SEQ ID NO: 36 - protein, 523 aa, Ophioglossum pendulum
MLSSGVYVSLEDQQLVMAAQGVETLSQLAPATDKVQNSDMAEEDPIFTQLAKKMAVAAEKEEVPVDLLAQYMQVEAHDWHNRVRGAILGLISAVPKVGAAISRLIGLFWPANKVDIWEALKLEEYIRNIVQQELFEFELRLLENDIQALETTVGRYDMAALTEKGNFLSIWISQADALYIRMRNSTNNIHLLLHMVTVSTLHLAALHERLTFGEELYGTNNSVNWTQDLVEKFERYTADLIPNVFKRWKEWRPTQIEIRAWVRRGSCGNLVCRPDVSYATVEDKISGALFSFQATNRNSTTIFLEVCEDHKTRMVNEAIADMASCLSPTFAFHKLLPDNIQAQFSPHDRQQFGQVLRGPYSQDLSHGLWTVFKSFRSRTTRSDQTLRDRILEVIIRAGHHVDAIQFVYDHANPNLTTPGTVAGNAAGGNTHQVDVRDRPIQEVRMEFSQDVLASLQLHFEDGTSTRKFGNELGWATRILTCTAPYGYRFSSWAFREDPGPYRTTAISVLRFQFTPELDMPLPI

SEQ ID NO: 37 - protein, 523 aa, Ophioglossum pendulum
MLSSGVYVSLEDQQLVMAAQGVETLSQLAPATDKVQNSDMAEEDPIFTQLAKKMAVAAEKEEVPVDLLAQYMQVEAHDWHNRVRGAILGLISAVPKVGAAISRLIGLFWPANKVDIWEALKLEEYIRNIVQQELFEFELRLLENDIQALETTVGRYDMAALTEKGNFLSIWISQADALYIRMRNSTNNIHLLLHMVTVSTLHLAALHERLTFGEELYGTNNSVNWTQDLVEKFERYTADLIPNVFKRWKEWRPTQIEIRAWVRRGSCGNLVCRPDVSYATVEDKISGALFSFQATNRNSTTIFLEVCEDHKTRMVNEAIADMASCLSPTFAFHKLLPDNIQAQFSPYDRQQFGQVLRGPYSQDLSHGLWTVFKSFRSRTTRSDQTLRDRILEVIIRAGHHVDAIQFVYDHANPNLTTPGTVAGNAAGGNTHQVDVRDRPIQEVRMEFSQDVLASLQLHFEDGTSTRKFGNELGWATRILTCTAPYGYRFSSWAFREDPGPYRTTAISVLRFQFTPELDMPLPI

SEQ ID NO: 38 - protein, 510 aa, Pellaea falcata
MAAKDVSELAPAADDEVQNADEEDPIFSQLAQKMVAAAEAGEVPVVDLLAQYRHVEAHDWHNRIRGAVLALIALVPKVGAAISKLVGLFWPANRVNIWEALNAEQYIRNIVQQEIFEFEMQLLRSDIQALETTVARYDRAAALNEKGNFLSIWISQADALYSRMRNSANNIHLLLHMVTVSTLHLAALHERMTFGQELYGTNNSANWTQDLVDKFALYTTDLIPSVFKRWKDWRPTQIEITAWTRPGSCSNVMGCGPNMSYARVEDKVSGAIFTFQARNQLSTTIFSGICQDHRTRMVNEAIADMASCLSPTFAFHRLLPAYIQPRFSAFDREQFGQVFRGPYSEDLSHGAWFHLKAFRSHTTRSDQTNRDRILQVIIRAGHHVDAIQFMYDHANSNALTPGIIAGNSAGGNRHEVNVRDPPMQELRMEFAHDVLASLQIHFEGGTSTRRFGNELGWASSILTCTAPYGYRFSSFAFREDTGPYRTTAISVLRFQFTPELDIPLPAQYII

SEQ ID NO: 39 - protein, 527 aa, Adiantum aethiopicum
MAAEEAKYAGSEVATTPAAEEVQKNDLAPSAVDMQEAEEDPIFAQLKREMQAAAAVKGQELPVVDLIDKYMQVQAHDWHNRIRGAILGLISLVPVVGRGVSKLVGLFWPTTKVDIWEALKMEQYIRNIVQQEIFEFEMRLLQSDIAALETTVGRYDRATSLIEKGNFLSIWITQADALYFRMRDSTNNIHLLLHIVTVSTLHIAALHERLTFGEELYGTNNAANWTRDLVDKFRLYTVDLLPSIFRRWKVWREAQIEIRAWIDWGSCGNLSCRPNVSHATVRDKVSGVVLAFRAQNRASTTIFSGLCEGHKTRMQNEAVADMASCLSPTFAFHKLLPDNIQAQFSAFDREQFGQVFRGPYSQDLSYEALTMNVLKSFITSPTTFDHTVGRVLEVNIRSGHHVDAIRFWYGHLDSNSMTPGIMGGNSGGGTSHQVDVRGRLIQDLRMEFSHDILAALQLHFQDGTFTRKFGNELGWASRVLTCTAPYGYRLSSWAFRQDEGPYRTAAISVLRFQFTPELDFPVPEEYM

SEQ ID NO: 40 - protein, 527 aa, Adiantum aethiopicum
MAAEEAKYAGSEVATTPAAEEVQKNDLAPSAVDMQEAEEDPIFAQLKREMQAAAAVKGQELPVVDLIDKYMQVQAHDWHNRIRGAILGLISLVPVVGRGVSKLVGLFWPTTKVDIWEALKMEQYIRNIVQQEIFEFEMRLLQSDIAALETTVGRYDRATSLIEKGNFLSIWITQADALYFRMRDSTNNIHLLLHIVTVSTLHIAALHERLTFGEELYGTNNAANWTRDLVDKFRLYTVDLLPSIFRRWKVWREAQIEIRAWIDWGSCGNLSCRPNVSHATVRDKVSGVVLAFRAQNRASTTIFSGLCEGHKTRMQNEAVADMASCLSPTFAFHKLLPDNIQAQFSAFDREQFGQVFRGPYSQDLSYEALTMNVLKSFITSPTTFDHTVGRVLEVNIRSGHHVDAIRFWYGHLDSNSMTPGIMGGNSGGGTSHQVDVRGRLIQDLRMEFSHDILAALQLHFQDGTSTRKFGNELGWASRVLTCTAPYGYSLSSWGFRQDEGPYRTAAISVLRFQFAPDLDFPVPEEYM

SEQ ID NO: 41 - protein, 521 aa, Lygodium flexuosum
MAAPGLMSSAVTIADGVHDNVSAPAATEGVPDVVVEDHGIKILSASAEAEVEETDVVVEQPQPVLQLPDYYIQVNADDWHNRIRSAILQLASGIPVVGNAVSILLGLFWPANRVNIFESIELEQYIRNIVKQEIFEFELRQHMSDIEALEDTVRSYDRAALREKGNFLTAWITQSNILATRLRNSQNNIHLLLHIVTVATLHMAALHERFTFGKELYAEDNTTNWQEDLVAAFRRYAYEVLPVIFRQWKSWRESQVQIETWTRNAQHGVINYRPASSHATVEDRHSGERFVFRRDGIRSTTIFLPVCEDHRTRMGNEAVADMASYISPTFAFHKLLPDDVQRLLHAYDEQQFGRVFRGPYSRDLLWNNVSSSSAIDFRSSTNRNDFVTSRHGVVEVNIRAGHHVDAIQFRYGAANSGNVLGVMAGNNRGGTLRQFDVRHRAIESVRMEFAQNILAAIQLDFDDGTTTRRLGNQLDWPTWVATCTTPFGYTLSSWAYRQDNGPYGTAAPSVLRFQYAPPIEP

SEQ ID NO: 42 - protein, 441 aa, Lygodium flexuosum
MAVVASDWNNRIRDAVIKISSKIPEVGSVVSILIGTFWPQDKLDIFQALKADVTKLVKQEILEHELNQRQSEIDALKVLIARYHAAKAHEKGNFLSNWITEADRLSVIFRQSENNIHLILPIITLALLHLTGLRERLYFGKELYYEDNTKQWKEDLEDMYKTYIVDFLPDVFRRWKLWRAEQVQIKSWVERYPMAMLPQSHATVADAMTGDWRHFSVDLTDSKTNVFPEICEDHKTRICNDASIDLADCISTTFVFLKLLPDNSKNFPEYDKEVFGRMFKGPYSQDLFPTDQSFGFGNPEPIFRTHPDHDDYKAGSGPITKVVIREWNTIDAMQFIYANRQGVLAGNRDGGERHEIDVADKPINGLRMGFSNGLLTYVQILFCDGTSSSTHGNRSGWKCDEVSPKGPSAYKVSSWSCRVDDGPSNSYGPSVIQLEYAPQME

SEQ ID NO: 43 - protein, 441 aa, Lygodium flexuosum
MAVVASDWNNRIRDAVIKISSKIPEVGSVVSILIGTFWPQDKLDIFQALKADVTKLVKQEILEHELNQRQSEIDALKVLIARYHAAKAHEKGNFLSNWITEADRLSVIFRQSENNIHLILPIITLALLHLTGLRERLYFGKELYYEDNTKQWKEDLEDMYKTYIVDFLPDVFRRWKLWRAEQVQIKSWVERYPMAMLPQSHATVADAMTGDWRHFSVDLTDSKTNVFPEICEDHKTRICNDASIDLADCISTTFVFLKLLPDNSKNFPEYDKEVFGRMFKGPYSQDLFPTDQSFGFGNPEPIFRTHPDHDDYKAGSGPITKVVIREWNTIDAMQFIYANRQGVLAGNRDGGERHEIDVADKPINGLRMGFSNGLLTYVQILFCDGTSSSTYGNRSGWKCDEVSPKGPSAYKVSSWSCRVDDGPSNSYGPSVIQLEYAPQME

SEQ ID NO: 44 - protein, 441 aa, Lygodium flexuosum
MAVVASDWNNRIRDAVIKISSKIPEVGSVVSILIGTFWPQDKLDIFQALKADVTKLVKQEILEHELNQRQSEIDALKVLIARYHAAKAHEKGNFLSNWITEADRLSVIFRQSENNIHLILPIITLALLHLTGLRERLYFGKELYYEDNTKQWKEDLEDMYKTYIVDFLPDVFRRWKLWRAEQVQIKSWVERYPMAMLPQSHATVADAMTGDWRHFSVDLTDSKTNVFPEICEDHKTRICNDASIDLADCISTTFVFLKLLPDNSKNFPEYDKQVFGRMFKGPYSQDLFPTDQSFGFGNPEPIFRTHPDHDDYKAGSGPITKVVIREWNTIDAMQFIYANRQGVLAGNRDGGERHEIDVADKPINGLRMGFSNGLLTYVQILFCDGTSSSTYGNRSGWKCDEVSPKGPSAYKVSSWSCRVDDGPSNSYGPSVIQLEYAPQME

SEQ ID NO: 45 - protein, 447 aa, Pteris albolineata
MVGVDVNASDWNNRIRDAVMKLSAKIPEVGAVVSTLIGFLWPQNKVDIFQALKADVIKLVKKEILDYELNLHESEIDALKITIERYKAAKTNEKAYFLNNWVTESDKLSVIFRESTNNIHLILPVITLALLHLTGLRERLDYGKELYHEDNTKQWKEDLEEMYKTYIVNFLPDIFKKWKVWRAQQVEIKAWTEPHPTAIPPFFRIESHATVVDTMTGERKHFSADLTESTTIFASVCEDHKTRMCNDATADMAGCISTTFLFDKILPDNKKNLPKYDKGVFGRMFKGPYSQDLLLSDQNFGFGNPVKTFRTRPNQDDYSPSSGPITKVIIREWNTIDAMHFIYANRQGHLAGNAQGGQRHDIDVTGKPISGFRMGFSNGLLTFIQVLYYDGTSSSTYGNRSGWRCYEASAKGPSAYRVSSWSYKVDRGPSDTSGPSVVQLEYAPQIE

SEQ ID NO: 46 - protein, 447 aa, Pteris albolineata
MVGVDVNASDWNNRIRDAVMKLSAKIPEVGAVVSTLIGFLWPQNKVDIFQALKADVIKLVKKEILDYELNLHESEIDALKITIERYKAAKPNEKAYFLNNWVTESDKLSVIFRESTNNIHLILPVITLALLHLTGLRERLDYGKELYHEDNTKQWKEDLEEMYKTYIVNFLPDIFKKWKVWRAEQVEIKAWTEPHPTAIPPFFRIESHATVVDTMTGERKHFSADLTDSMTIFASICEDHKTRMCNDATADMAGCISTTFLFDKILPDNKKNLPKYDKGVFGRMFKGPYSEDLLLSDQNFGLGYPVKIFRARPNQDDYSPSSGPITKVIIREWNTIDAMHFIYANRQGHLAGNAQGGQRHDIDVTGKPISGFRMGFSNGLLTFIQVLYYDGTLSSTYGNRSGWRCYEASAKGPSAYTLSSWSYKVDRGPSDTYGPSVVQLEYAPQIE

SEQ ID NO: 47 - protein, 447 aa, Pteris albolineata
MVGVDVNASDWNNRIRDAVMKLSAKIPEVGAVVSTLIGFLWPQNKVDIFQALKADVIKLVKKEILDYELNLHESEIDALKITIERYKAAKPNEKAYFLNNWVTESDKLSVIFRESTNNIHLILPVITLALLHLTGLRERLDYGKELYHEDNTKQWKEDLEEMYKTYIVNFLPDIFKKWKVWRAEQVEIKAWTEPHPTAIPPFFRIESHATVVDTMTGERKHFSADLTESTTIFASVCEDHKTRMCNDATADMAGCISTTFLFGKILPDNKKNLPKYDKGVFGRMFKGPYSQDLLLSDQNFGLGNPVKTFRTRPNQDDYSPSSGPITKVIIREWNTIDAMHFIYANRQGHLAGNAQGGQRHDIDVTGKPISGFRMGFSNGLLTFIQVLYYDGTLSSTYGNRSGWRCYEASAKGPSAYTLSSWSYKVDRGPSDTYGPSVVQLEYAPQIE

SEQ ID NO: 48 - protein, 447 aa, Pteris albolineata
MVGVDVNASDWNNRIRDAVMKLSAKIPEVGAVVSTLIGFLWPQNKVDIFQALKADVIKLVKKEILDYELNLHESEINALKITIERYKAAKTNEKAYFLNNWVTESDKLSVIFRESTNNIHLILPVITLALLHLTGLRERLDYGKELYHEDNTKQWKEDLEEMYKTYIVNFLPDIFKKWKVWRAQQVEIKAWTEPHPTAIPPFFRIESHATVVDTMTGERKHFSADLTESTTIFASVCEDHKTRMCNDATADMAGCISTTFLFDKILPDNKKNLPKYDKGVFGRMFKGPYSQDLLLSDQNFGLGYPVKTFRTRPNQDDYSPSSGPITKVIIREWNTIDAMHFIYANRQGHLAGNAQGGQRHDIDVTGKPISGFHMGFSNGLLTFIQVLYYDGTSSSTYGNRSGWRCSEASAKGPSAYRVSSWSYKVDRGPSDTSGPSVVQLEYAPQIE

SEQ ID NO: 49 - protein, 440 aa, Adiantum polyphyllum
MAIVASDWNNRIRDVVMKLSSKIPEVGTVVNIFIGFFWPENKTDIFEALKADITKLVKKQILDYELNLHKSEINALKSIIERYKKAAKKHEKGNFLSNWITEADKLSVIFRQSTNNIHLILLVITLALLHLAGLRERLDFGKEIYEEDNTKQWKEDLEAMYKTYIVDFLPDIFQKWKVWRANQVEIKAWTKMSRPLLYDSYATVEDTITGEKKSFFVGEHNSTTTFANICQDHKTRMCNDANADMAGCISTTFVFDKILPDNKKNLPKYDKNVFGRMFRGPYSEDLFYPDRKFNFYRDIPIFRSRPNHDDYASNSGAITKVIIREWNTVDAMQFIYANRQGSVAGNPKGGHMNEINVMGKPISGLRMGFSNGLLTYAQIIYCDGTSTSTYGNRGGWRCVEASPKAPTAYKVSSWSYKEDRGPSRTYGPSVVQLEYVPQIE

SEQ ID NO: 50 - protein, 439 aa, Adiantum polyphyllum
MAIVASDWNNRIRDVVMKLSSKIPEVGTVVNIFIGFFWPENKTDIFEALKADITKLVKKQILEYELNLHKSEINALKIIIQRYKAAKIHEKGNFLSNWITEADKLSVIFRQSTNNIHLILLVITLALLHLAGLRERLDFGKEMYQEDNTKQWKEDLEAMYKTYIVDFLPDIFKKWKVWRANQVEIKAWTKMSRPLLYDSYATVEDTITGEKKSFFVGEHNSTTTFANICQDHKTRMCNDANADMAGCISTTFVFDKILPDNKKNLPKYDKNVFGRMFRGPYSEDLYYPDRKFNFYRDVPIFRSRPNHDDYASNSGAITKVIIREWNTVDAMQFIYVNRQGFVAGNPKGGHMNEINVMGKPISGLRMGFSNGLLTYAQIIYCDGTSTSTYGNRGGWRCVEASPKAPTAYKLSSWSYKEDRGPSRTYGPSVVQLEYVPQIE

SEQ ID NO: 51 - protein, 440 aa, Adiantum polyphyllum
MAIVASDWNNRIRDVVMKLSSKIPEVGTVVNIFIGFFWPENKTDIFEALKADITKLVKKQILDYELNLHKSEINALKSIIERYNKAAKKHEKGNFLSNWITEADKLSVIFRQSTNNIHLILLVITLALLHLAGLRERLDFGKEIYEEDNTKQWKEDLEAMYKTYIVDFLPDIFQKWKVWRANQVEIKAWTKMSRPLLYDSYATVEDTITGEKKSFFVGEHNSTTTFANICQDHKTRMCNDANADMAGCISTTFVFDKILPDNKKNLPKYDKNVFGRMFRGPYSEDLFYPDRKFNFYRDIPIFRSRPNHDDYASNSGAITKVIIREWNTVDAMQFIYANRQGSVAGNPKGGHMNEINVMGKPISGLRMGFSNGLLTYAQIIYCDGTSTSTYGNRGGWRCVEASPKAPTAYKVSSWSYKEDRGPSRTYGPSVVQLEYVPQIE

SEQ ID NO: 52 - protein, 533 aa, Blechnum occidentale
MAAPGVKAEDVTASPAEPEENVHEVKLATTTDMEEGGGPLHGEKAGGVSSSHQHHEAGSLDDAIVEEFARNSQMEAHDWHNRTRDVVLALISIIPTVGAIASVVLGIFWPANKVDIWVALSLEEYVRNIVKQEIFEFEMRQHQSSIEALESTIRRYNTAALPEKGNFLSIWISQADALCIRLRNSTNDIHLLLHIVTVSVLHMAAMHERLTFGEELYGTDNTANWTRDLVEVFQMYTSDLIPSLFRKWKQWREGLIEIRSWVVPGRWGNLVQLPDVSHATVEDKLTGAIVRFSVARRNSTTIFLDVCQDHKSRMANEAVADMASCMSSTFAFRSLLPDRIQGQYPAYDRELFGQVFRGPYSQDHCRLVVTEFRTFRTRPTHFDQTAIDRVSELIVMTAIHFGTMQFVYFDNNSRIPGLVAGNASGGGRWQRHVIDVLDKPIRDLRLEFNNEALASLQLSFEDGSSTPRLGNFSGSAEEKVTCTVPRGYRLSSWAFRADPAISVLRFQFTPEELRPSSRVRPQYTTPALHPIIN

SEQ ID NO: 53 - protein, 401 aa, Blechnum medium
MAALDHTKDSEIIAGRAVATDHDPATVVSEEDSETKIAEVACDPATAGDPAGEVHELDKLALECGSDGIDLLAKRMQVDAHDWHNRLRGAVLGLLSDLPLGGAISTLVGLFWPATRVNIWEALGMEAYVTNIVRKEIFEFEMRQHESDIEALERSILRYERGLLTEKATALGIWIAQADALSIRLGNSTNRIHLLLHIVTVAVLHMAALHERLTFGEEIYGANNTANWTKELEETFQRYTSDRIPVILKTFRMHPTRSDIMLGTRVLQVNVRAGTLLESIQFVYYHPSSPNGIPNWGNIAGNPRGGESFVVDVRTRHIQDLRLEFSRDVLVSLQIRFEDGTSTQKFGNATGWATSAVTCTAPSGYTLNSWDFREDPGPNGTTAISVAGYGFTPDDIRLPPA

SEQ ID NO: 54 - protein, 450 aa, Gymnocarpium dryopteris
MQMQKGTAVADVRASDWNNRIRDAVLKLSSKIPEVGTAASILIGFLWPENKIDVFQAIKADVINLVKKEILASELNRHHSEIDGLKLAIQRYKAAQTHEKACWLTSWITKADSLSLIFRQSTNNIHLILPLITLALLHLTGLRERLDFGKTLYNEDNTKQWKEDLEQMYKTYIVDFLPDIFKKWKVWRADQVEIKAWTSKHLTTIPPFFLYEAHATVVDTVTGETKRYFKDDLNSTTHFASICQDHKTRMCNDATSDMAGGISTTFMFDKLLPDNNKKFPKYDKKVFGRMFKGPYAEGLLREEKYVPDFRTRPDRDDYSPNSGPITKVIIREWNTIDAMQFIYANRQGLVAGNASGGKRHDVDVMGNKPINGLRMGFSNGLLTYVQIMYCDGTSSDTYGNRSGWRCQEVSANGPSAYKLSSWSYKVNQGPSGTSGPGVIQLEYTPQLMAE

SEQ ID NO: 55 - protein, 450 aa, Gymnocarpium dryopteris
MQMQKGTAVADVRASDWNNRIRDAVLKLSSKIPEVGTAASILIGFLWPENKIDVFQAIKADVINLVKKEILASELNRHHSEIDGLKLAIQRYKAAQTHEKACWLTSWITKADSLSLIFRQSTNNIHLILPLITLALLHLTGLRERLDFGKTLYNEDNTKQWKEDLEQMYKTYIVDFLPDIFKKWKVWRADQVEIKAWTSKHLTTIPPFFLYEAHATVVDTVTGETKRYFKDDLNSTTHFTSICQDHKTRMCNDATSDMAGGISTTFMFDKLLPDNNKKFPKYDKKVFGRMFKGPYAEGLLREEKYVPDFRTRPDRDDYSPNSGPITKVIIREWNTIDAMQFIYANRQGLVAGNASGGKRHDVDVMGNKPINGLRMGFSNGLLTYVQIMYCDGTSSDTYGNRSGWRCQEVSANGPSAYKLSSWSYKVNQGPSGTSGPGVIQLEYTPQLMAE

SEQ ID NO: 56 - protein, 450 aa, Gymnocarpium dryopteris
MQMQKGTAVADVRASDWNNRIRDAVLKLSSKIPEVGTAASILIGFLWPENKIDVFQAIKADVINLVKKEILASELNRHHSEIDGLKLAIQRYKAAQTHEKACWLTSWITKADSLSLIFRQSTNNIHLILPLITLALLHLTGLRERLDFGKTLYNEDNTKQWKEDLEQMYKTYIVDFLPDIFKKWKVWRADQVEIKAWTSKHLTTIPPFFLYEAHATVVDTVTGETKRYFKDDLNSTTHFTSICQDHKTRMCNDATSDMAGGISTTFMFDKLLPDNNKKFPKYDKKVFGRMFKGPYAEGLLREEKYVPDFRTRPDRDDYSPNSGPITKVIIREWNTIDAMQFIYANRQGLVAGNASGGKRHDVDVMGNKPINGFRMGFSNGLLTYVQIMYCDGTSSDTYGNRSGWRCQEVSANGPSAYKLSSWSYKVNQGPSGTSGPGVIQLEYTPQLMAE

SEQ ID NO: 57 - protein, 450 aa, Gymnocarpium dryopteris
MQMQKGTAVADVRASDWNNRIRDAVLKLSSKIPEVGTAASILIGFLWPENKIDVFQAIKADVINLVKKEILASELNRHHSEIDGLKLAIQRYKAAQTHEKACWLTSWITKADSLSLIFRQSTNNIHLILPLITLALLHLTGLRERLDFGKTLYNEDNTKQWKEDLEQMYKTYIVDFLPDIFKKWKVWRADQVEIKAWTSKHLTTIPPFFLYEAHATVVDTVTGETKRYFKDDLNSTTHFASICQDHKTRMCNDATSDMAGGISTTFMFDKLLPDNNKKFPKYDKKVFGRMFKGPYAEGLLREEKYVPDFRTRPDRDDYSPNSGPITKVIIREWNTIDAMQFIYANRQGLVAGNASGGKRHDVDVMGNKPINGLRMGLSNGLLTYVQIMYCDGTSSDTYGNRSGWRCQEVSANGPSAYKLSSWSYKVNQGPSGTSGPGVIQLEYTPQLMAE

SEQ ID NO: 58 - protein, 460 aa, Polystichum acrostichoides
MDSQKVAVSGPITLVDVVASDWNNRIRDTVMKISSKIPEVGAVVSIIIGFFWPQNKIDVFQALKADLTKLVKKEILEFELNQRQSEIDALKLIIERYKAAKNHEKAYFLNNWITEADKLSVIFRQSTNNIHLILLVINLAVLHLTGLRERLDFGKELYDEDNTKRWKEDLEEMYKAYVVDFLPDIFKKWKVWRADQVEIKAWVETHPTAIPPFFRMESHATVVDTITGERKHFSVDLTESMAIFARICEDHKTRMCNDAFGDMAGCISTTFVFVKLLPDNNKNFPKYDKEVFGRMFKGPYSEDLYWPDRNFGLGYPVPVFRTRPDHHDYSSNSGPITKVIIREWNSIDAMQFIYANRQGLLAGNAQGGQRHDVDVTGKPINGLHMGFGSGVLASVQIIYYDGTLSLSSKYGNRSGWKLQEVSANGPTAYRVSSWSYKVDQGPSNSSGPSVIQLEYTPQIE

SEQ ID NO: 59 - protein, 412 aa, Polystichum acrostichoides
MDSQKVAVSGPITLVDVVASDWNNRIRDTVMKISSKIPEVGAVVSIIIGFFWPQNKIDVFQALKADLTKLVKKEILEFELNQRQSEIDALKLIIERYKAAKNHEKAYFLNNWITEADKLSVIFRQSTNNIHLILLVINLAVLHLTGLRERLDFGKELYDEDNTKRWKEDLEEMYKAYVVDFLPDIFKKWKVWRADQVEIKAWVETHPTAIPPFFRMESHATVVDTITGERKHFSVDLTESMAIFARICEDHKTRMCNDAFGDMAGCISTTFVFVKLLPDNNKNFPKYDKEVIIREWNSIDAMQFIYANRQGLLAGNAQGGQRHDVDVTGKPINGLHMGFGSGVLASVQIIYYDGTLSLSSKYGNRSGWKLQEVSANGPTAYRVSSWSYKVDQGPSNSSGPSVIQLEYTPQIE

SEQ ID NO: 60 - protein, 460 aa, Polystichum acrostichoides
MDSQKVAVSGPITLVDVVASDWNNRIRDTVMKISSKIPEVGAVVSIIIGFFWPQNKIDVFQALKADLTKLVKKEILEFELNQRQSEIDALKLIIERYKAAKNHEKAYFLNNWITEADKLSVIFRQSTNNIHLILLVINLAVLHLTGLRERLDFGKELYDEDNTKRWKEDLEEMYKTYVVDFLPDIFKKWKVWRADQVEIKAWVETHPTAIPPFFRMESHATVVDTITGERKHFSVDLTESMAIFARICEDHKTRMCNDAFGDMAGCISTTFVFVKLLPDNNKNFPKYDKEVFGRMFKGPYSEDLYWPDRNFGLGYPVPVFRTRPDHHDYSSNSGPITKVIIREWNSIDAMQFIYANRQGLLAGNAQGGQRHDVDVTGKPINGLHMGFGSGVLASVQIIYYDGTLSLSSKYGNRSGWKLQEVSANGPTAYRVSSWSYKVDQGPSNSSGPSVIQLEYTPQIE

SEQ ID NO: 61 - protein, 475 aa, Cheilanthes sieberi
MLRSASNSYVIMSIQNSACHKIALSKLNPEMADVVASDWNNRIRGTVMRLSSKVPEVGAVVSILIGFLWPENKVDVFQALKADITKLIKKEILDYELNLHASEIDALKIIIERYKEAKNNEKGYFLNSWITEADKLSVIFRQSTNNIHLILPVITLALLHLTGLRERLDFGRELYHEDNTKQWKEDLEDMYKTYIVNFLPTIFKKWKLWRTDQVEIKPWTETHPTAIPPFFRIESHATVVDTITGERKHFSADLTDSKTTFARICDDHKTRMCNDASSDMAGCISATFVYDKLLPDNKKNLPKYDKGVFGRMFKGPYSADLLLSDRSFGVGNPVPIFRTRPDQDDYSPSSGQITKVVIREWNSIDAMYFIYANRQGRIAGNASGGQRHDIDVTRKPINGLRMGFSNGVLTSVQILYYDGTSSSTYGNRSGWKCYETFAKGPTAYRVSSWSFKVDRGPSNTYGPSVIQLEYAPLIE

SEQ ID NO: 62 - protein, 500 aa, Polypodium vulgare
MDSEMIAAPPAAMDDQLAAQEKMTVPAGDNVEKLDQLGVDVLARNMQIEAHDWQNRLRRSIMTLASKIPKVGGAVSLLIGLFWPANKVDIWEAINGEEYVRNIVQQEIFEFELQQLRSDIEALQATVSRYNMAALTEKGNFLSIWIAQADALSIRMRNSSNNIHLLLHLVTVAVLHVAALHERLTFGEELYGSNHTASWKQDLVNLFQLYTSDIVPKLFKEWRQWRESQIEIKAWVVRGAWGNLVSRPDVSHATVEDKISREMFTFRETRRNSTTIFSDVCQDHKTRMMNEAIADMASCMSPTFAFHKLLPDDIQTQFPAYDKELFEQVFRGPYSQDLLQKLFTTLKAFRSRPTRVDQTARNRILEVVVRAGHHVDAIQFWYDHVNSNSMTAGTMAGNPTGGNRHLVNVRNRPIHELRMEFSHDVIVSLQLRFEDGTSTSKFGNTIGWASSIVTCTAPSGYRLSSWAFREDSGPYNTTAISVLRFQFTPEDPASLEDPSS

SEQ ID NO: 63 - protein, 517 aa, Adiantum hispidulum
MAAPGMNIMDSVDDPMQEMIAHKDDVINSDSTVSVGEAHELVQDNTVVADAALHGDGVADKEQVDVDVLAQNVRMEAHDWHNRIRDAILGLISEVPMVGAGISTLIGLFWPANQVDIWEAINAEQYIKNIVRQEIFEFELQQHLSDIEALQVTVLRYERAAPNEKGNFLSIWISQADKLIIRMRNSANNIHLILHIVTVSVLHVAAMHERLMFGEELYGPNPTASWEKELVEVFKMYTFDLLVRVFEDWKQWRVEQIEIKAWTVKSQWGGITQNRPARSHATVEDKLSGEIMRFQVDNQLSTTVFSAICEDHKARMMNEAVADMASCISPTFGFHKLLPPAIQRQHPAYGAVFTTVFRGPYSLDLLIRNSTRQTSFRSRTTRDDILPRSDETILEVFIRSGTHIDAIQFLYGVTPNMTRPGIMAGNSVGGHSNKVDVRGRPIHQLHMEFSRGVLASLRLGFQDGTSTQRYGLERGQLAATCTAPSGYRFRSWAFREDLGPYSSSAISVLRFQFTPDD

SEQ ID NO: 64 - protein, 517 aa, Adiantum hispidulum
MAAPGMNIMDSVDDPMQEMIAHKDDVINSDSTVSVGEAHELVQDNTVVADAALHGDGVADKEQVDVDVLAQNVRMEAHDWHNRIRDAILGLISEVPMVGAGISTLIGLFWPANQVDIWEAINAEQYIKNIVRQEIFEFELQQHLSDIEALQVTVLRYERAAPNEKGNFLSIWISQADKLIIRMRNSANNIHLILHIVTVSVLHVAAMHERLMFGEELYGPNPTASWEKELVEVFKMYTFDLLVRVFEDWKQWRVEQIEIKAWTVKSQWGGITQNRPARSHATVEDKLSGEIMRFQVDNQLSTTVFSAICEDHKARMMNEAVADMASCISPTFGFHKLLPPAIQRQHPAYGAVFTTVFRGPYSLDLLIRNSTRQTSFRSRTTRDDILPRSDETILEVFIRSGTHIDAIQFLYGVTPNMTRPGIMAGNSVGGHSNKVDVRGRPIHQLHMEFSRGVLASLRLGFQDGTSTQRYGLERGQLAATCTAPSGYRFRSWAFREDLGPHSSSAISVLRFQFTPDD

SEQ ID NO: 65 - protein, 515 aa, Colysis ampla
MAALDMKDSEMIAGAVATPTVVSEEDLETIAEVSTVTVVCDPAGEVHELDKLVLQGGNDNIDLLARHLQMEAHDWHNRIRSAVLALMSDIPGVGGTVSFVVGLFWPASKVNIWEALNAEAYVSNIVRREIFEFEMRQHEAAIQALEGTIRRYETGSLSQKAIDLRIWIAQADALSLRLGNSSNRIHLLLHIVTVAVLHMTALHEQLAFGEELYGTDNTANWTKELEEQFQRYTSERIPVIFKEWSPWRESQIEIRAWRRRASGMVIYNPDASFAAVEDKLSGEIFNFSVGYHYSTTIFLDICEAHKARMMNEAIADMASCMSPTFAFHKLLPNDSQSKFSPYDRQLFGQVFRGPYSQDLLQPLFTNLKTFRLHPTRFDQTFRNKILQVTVRAGTVLEAMQFWYDHASPNAMTQGIMAGNPTGGFRFDVDVRTRRIQDLRLEFSRDVLVSLQIRFEDGSSTQRFGSDAGWPSNTVTCTAPSGYRLSSWAFREDTGPNNRTAISIVRFRFTPDDPLP

SEQ ID NO: 66 - protein, 515 aa, Colysis ampla
MAALDMKDSEMIAGAVATPTVVSEEDLETIAEVSTVTVVCDPAGEVHELDKLVLQGGNDNIDLLARHLQMEAHDWHNRIRSAVLALMSDIPGVGGTVSFVVGLFWPASKVNIWEALNAEAYVSNIVRREIFEFEMRQHEAAIQALEGTIRRYETGSLSQKAIDLRIWIAQADALSLRLGNSSNRIHLLLHIVTVAVLHMTALHEQLAFGEELYGTDNTANWTKELEEQFQRYTSERIPVIFKEWSPWRESQIEIRAWRRRASGMVIYNPDASFAAVEDKLSGEIFNFSVGYHYSTTIFLDICEAHKARMMNEAIADMTSCMSPTFAFHKLLPNDSQSKFSPYDRQLFGQVFRGPYSQDLLQPLFTNLKTFRLHPTRFDQTFRNKILQVTVRAGTVLEAMQFWYDHASPNAMTQGIMAGNPTGGFRFDVDVRTRRIQDLRLEFSRDVLVSLQIRFEDGSSTQRFGSDAGWPSNTVTCTAPSGYRLSSWAFREDTGPNNRTAISIVRFRFTPDDPLP

SEQ ID NO: 67 - protein, 526 aa, Adiantum formosum
MAASATSADPQLKLVEDNVNVTTEEKNVESVIMTAPDSDDEAQPEQEWMITDVNVSITAAAAAAAVKLGLGKEVDVLAKYMEIEAHDWNNRIREVVIGLASYIPVVGDAVSMLIGIFWPTSKVDIWQALNAEQYVRNIVQQEIFQFELQLLQSDMDTLKTTILRYEGAALNEKRGFLTSWIGLADGLCNRMRNSRNNIQLLLHIVTVSVLHVTALLERLNFGEEIYNENNTARWKQDLVDLFKMYTFDILPSIFNEWQVWRVRQIEIEAWRRRAQFGPVMFTPDSSHATVEDKLSGEKITFRVNYQYSTTIFSAVCEDHKTRMGNEAVADMASCISPTFGFHKLLPADSQAQFSPYDKSAFGRVFRGPYSQDLLWRSFINVKDFRSRPTRFDQTARDRVLEMVIRAGHHVDAIQFWYNHANANAMTAGTMAGNPWGGNRFQVDVRGRPIQDLRMEFANDVLASLQLRFKDGTATQRFGNTQGWASNVVTCTTPAGYRLSSWAFREDPGPYHTQAISLLRFQFTPED

SEQ ID NO: 68 - protein, 526 aa, Adiantum formosum
MAASATSADPQLKLVEDNVNVTTEEKNVESVIMTAPDSDDEAQPEQEWMITDVNVSITAAAAAAAVKLGLGKEVDVLAKYMEIEAHDWNNRIREVVIGLASYIPVVGDAVSMLIGIFWPTSKVDIWQALNAEQYVRNIVQQEIFQFELQLLQSDMDTLKTTILRYEGAALNEKRGFLTSWIGLADGLCNRMRNSRNNIQLLLHIVTVSVLHVTALLERLKFGEEIYNENNTARWKQDLVDLFKMYTFDILPPIFNEWQVWRVRQIEIEAWRRRAQFGPVMFTPDSSHATVEDKLSGEKITFRVNYQYSTTIFSAVCEDHKTRMGNEAVADMASCISPTFGFHKLLPADSQAQFSPYDKSAFGRVFRGPYSQDLLWRSFINVKDFRSRPTRFDQTARDRVLEMVIRAGHHVDAIQFWYNHANANAMTAGTMAGNPWGGNRFQVDVRGRPIQDLRMEFANDVLASLQLRFKDGTATQRFGNTQGWASNVVTCTTPAGYRLSSWAFREDPGPYHTQAISLLRFQFTPED

SEQ ID NO: 69 - protein, 527 aa, Adiantum formosum
MAASATSADPQLKLVEDNVNVTTEEKQNVESVIMTAPDSDDEAQPEQEWMITDVNVSITAAAAAAAVKLGLGKEVDVLAKYMEIEAHDWNNRIREVVIGLASYIPVVGDAVSMLIGIFWPTSKVDIWQALNAEQYVRNIVQQEIFQFELQLLQSDMDTLKTTILRYEGAALNEKRGFLTSWIGLADGLCNRMRNSRNNIQLLLHIVTVSVLHVTALLERLKFGEEIYNENNTARWKQDLVDLFKMYTFDILPPIFNEWQVWRVRQIEIEAWRRRAQFGPVMFTPDSSHATVEDKLSGEKITFRVNYQYSTTIFSAVCEDHKTRMGNEAVADMASCISPTFGFHKLLPADSQAQFSPYDKSAFGRVFRGPYSQDLLWRSFINVKDFRSRPTRFDQTARDRVLEMVIRAGHHVDAIQFWYNHANANAMTAGTMAGNPWGGNRFQVDVRGRPIQDLRMEFANDVLASLQLRFKDGTATQRFGNTQGWASNVVTCTTPAGYRLSSWAFREDPGPYHTQAISLLRFQFTPED

SEQ ID NO: 70 - protein, 498 aa, Polypodium billardieri
MAAPGTKDSAEMVADVGTTTTVSVPDWEVQDLDKLGLQATNDIDVLANYMQMEAHDWHNRMRRAVLGLISAIPKVGAGISMLIGFFWPANRVDIWVALGMEEYVRNIVKQEIFEFEMQQHQSEIEALEATILRYDRAALPEKGNFLSIWISQADRLSIRLRNSTNRIHLLLHIVTVAVLHMAAMHERLTFGEELYGINHTTNWTKDLLDVFEMYTSNLVPTLFKEWRQWRESQIEIRAWVVRGVWGNITSTPDVSHATVEDKISGERFVFRVTRRNSTTIFSDVCQDHKTRMANEAIADMASCMSPTFAFHKLLPSNIQAQFPAYDKELFAQVFRGPYSQDLMQELFTALKAFRTRPTRFDQTARDRILEVIVRAGHHVDAIQFWYDHVNANAMTAGTMAGNPAGGSRHQVDVRNRRIQDLRLEFAQDVLVSLQFHFEDGTSTQKFGNVVGWATRIATCTTPAGYRLSSWAFREDQGPYNTTAISVLRFQFTPEDPSP

SEQ ID NO: 71 - protein, 498 aa, Polystichum braunii
MAAPGIKDVNTASVIAPLTAEEDQLVIMKAQQMIGDDVDLLSRNMQIEAHDWHNRTRGAILGLISLVPTVGAGISMLVGLFWPANKVDIWEAIKAEQYVRNIVKQEIFEFELQQLESDIEALQTAVGRYDRAGGPTERGNFLSIWITQADNLSIRLRNSSNNIHLLLHIVTVAVLHVAALHERLTFGEELYGVNHTASWKQDLVDKIEMYTSNVVPNIFRNWKPWRESQIEITAWGRRAQSGNLFYHPASSHATVEDKISGEMFTFQVTGQNSTTIFLGVCEDHKTRMVNEAIADMASCMAPTFVFHKLLPDDVQTQLSPYDKEVFGRVFRGPYSQDLSQRSFTSLKSFRSHPTRFDQTARDRILEVIIRAGNHVDAIQFWYDHVSNPNAMTEGTMAGNPTGGNSHKVDVRGRSIQQLRMEFANDVLTSLQLRFEDGTSTQKFGTEPGWGFSIETCTAPYGYRLSSWAFREDTGPYNSTAISLLRFQFTPELDDIPLA

SEQ ID NO: 72 - protein, 497 aa, Lygodium japonicum
MATPGMMDSAKDINTVSVLAPAAEEVQDDQLVMTAAPDMMDSVDPQSAQIEAHDWHNRMRSAILALASAIPKVGGAISMLISIFWPANRVDIWEAINAEQYVRNIVQQEIFEFELRQLQSDIQALEVTVSRYDTAAPNERGNFLSIWIAQADALSIRMRNSTNDIHLLLHIVTVAVLHVAALHERLTFGEELYGSNNTANWTQDLVDVFEMYTSNLIPNLFNKWKQWRESQIEIRAWVVRPPSGNLIFRPPVSHATVEDKLSGEIFTFRATNSTSTTIFSGVCEDHKTRMVNEAIADMASCMSPTFSFHKLLPDDIQTQFSPYDREVFGRVFRGPYSQDLLQPLFTSLRSFRSHPTRFDQTTRDRILEVIIRAGHHVDAIQFWYDHVNPNAMTAGTMAGNPAGGRRHQVNVRDRPIQDLRMEFSQNVLASLQLHFEDGTSTARFGNELGWASSIATCTAPYGYRLSSWAFRQDPGPYGTTAISVLRFQFTPELDFSS

SEQ ID NO: 73 - protein, 497 aa, Lygodium japonicum
MATPGMMDSAKDINTVSVLAPAAEEVQDDQLVMTAAPDMMDSVDPQSAQIEAHDWHNRMRSAILALASAIPKVGGAISMLISIFWPANRVDIWEAINAEQYVRNIVQQEIFEFELRQLQSDIQALEVTVSRYDTAAPNERGNFLSIWIAQADALSIRMRNSTNDIHLLLHIVTVAVLHVAALHERLTFGEELYGSNNTANWTQDLVDVFEMYTSNLIPNLFNKWKQWRESQIEIRAWVVRPPSGNLIFRPPVSHATVEDKLSGEIFTFRATNSTSTTIFSGVCEDHKTRMVNEAIADMASCMSPTFSFHKLLPDDIQTQFSPYDREVFGRVFRGPYSQDLLQPLFTSLRSFRSHPTRFDQTTRDRILEVIIRAGHHVDAIQFWYDHVNPNAMTAGTMAGNPAGGRRHQVNVRDRPIQDLRMEFSQNVLASLQLHFEDGTSTARLGNELGWASSIATCTAPYGYRLSSWAFRQDPGPYGTTAISVLRFQFTPELDFSS

SEQ ID NO: 74 - protein, 497 aa, Lygodium japonicum
MATPGMMDSAKDINTVSVLAPAAEEVQDDQLVMTAAPDMMDSVDPQSAQIEAHDWHNRMRSAILALASAIPKVGGAISMLISIFWPANRVDIWEAINAEQYVRNIVQQEIFEFELRQLQSDIQALEVTVSRYDTAAPNERGNFLSIWIAQADALSIRMRNSTNDIHLLLHIVTVAVLHVAALHERLTFGEELYGSNNTANWTQDLVDVFEMYTSNLIPNLFNKWKQWRESQIEIRAWVVRPPSGNLIFRPPVSHATVEDKLSGEIFTFRATNSTSTTIFSGVCEDHKTRMVNEAIADMASCMSPTFSFHKLLPDDIQTQFSPYDREVFGRVFRGPYSQDLLQPLFTSLRSFRSHPTRFDRTTRDRILEVIIRAGHHVDAIQFWYDHVNPNAMTAGTMAGNPAGGRRHQVNVRDRPIQDLRMEFSQNVLASLQLHFEDGTSTARFGNELGWASSIATCTAPYGYRLSSWAFRQDPGPYGTTAISVLRFQFTPELDFSS

SEQ ID NO: 75 - protein, 501 aa, Dryopteris lepidopoda
MTTPDMNMDSVDPHLAQETIADDVKIVSAPVAAGAEEGQEVTVDLFANYNMQMEAHDWHNRLRGAILGLLSAVPKVGAAVSKLIGLFWPANKVDIWEAINWEQYVRNIVKQEIFEFELQQHESDIEALQTTIRRYDTAAPNERGNFLSIWISQADTLCIRLRNSTNDFHLLLHIVTVAVLHVAALHERLTFGEELYGSSNTANWTQDLVDVFKMYTSDLIPNLFKKWKQWRVTQIEIKKWTQKSILMINSYATVEDKVSGEIFNFRAPNLYSTKQHVFSEVCEDHKTRMMNEAIADMASCLAPTFAFHKLLPEDTQTQSSPYDKELFGRVFRGPYSQDLLQPSFNIINRTISLRMHPTRFDQTTRDKILEVIIRAGYHVDAIQFWYDHVNPNAMTAGTMAGNSVGGNRYQVDVRDRPIQDLRMEFAQDVLASLQLHFEDGTSTLKFGNPSNLNWATSIATCTVPFGYRLSSWAFREDASSYSATAISVLRFQFTPEDIPSP

SEQ ID NO: 76 - protein, 541 aa, Pteridium esculentum
MQSKSLDYSLSLFYVDQLIVMAAPTMMMDSADPQLAQEMIAEDVEEVQDDQSVMTMPGMMDSVDPQLAQEMITDDVYNAFVRAAGGAEDGQEVTVDLLARYMQIEAHDWNNRIRAVILGLASAVPKVGAAIGMLIGFLWPANKVDIWEAINAEQYVLNIVRQEIFELEMRLYRSDIEALEATVLRYDRAALNEKGNFLSIWITQAHALSIRMRNSTNNIHLLLHIVTVATLHVAALHERLTFGEELYGENNTANWKKDLVEVFKMYTSDIVPTLFKNWKPWRESQIEIEAWRVRGQSGNLIVRPDVSHATVEDKLSGEKFTFRVINQYSTTIFSQICQDHKIRMMNEAIADMASCMSPTFGFHKLLPDDIQAQLPAYDREQFSLVYRGPYSQDLLQPLFTRLKAFRSRTTHFHNTLERISQVVIRAGHHVDALQFLYAGFAGPIAGNPTGGSRHQFDVRNRPIQEIRMEFSHDILASLQFHFEDGTSTQKFGNTLGWASSIATCTAPSGYMFTSRGFRSDPGPYGTAAISVIRFHFTPEDP

SEQ ID NO: 77 - protein, 511 aa, Pellaea falcata
MAAEDVNIVSELAPAANEVQNAEYEEDPIFSQLAQKMVAAAEAGEVPVDLLAQYMQVEAHDWHNRIRGAVLGLISAVPKVGAAISRLIGLFWPANRVDIWEALNAEEYIRNIVQQELFEFEMQLLRNDIEALETTVARYDRAALTEKGNFLSIWISQADALYIRMRNSTNNIHLLLHMVTVSTLHLAALHERLTFGEELYGTNNSANWTQDLVDKFELYTTDLIPSVFKRWKDWRPAQIEITAWVQRGSCGIVTCRPNVSYARVEDKVSGRRITFQASNVNSTTVFSGVCEDHKTRMMNEAIADMASCLSPTFAFHKLLPADIQPRFSAFDREQFGQVFRGPYSQDLSHGAWTILKAFRSHTTRSDQTNRDRVLEMIIRAGSHVDAIQFMYDHANPNATTAGIMAGNSAGGNRHRVDVRGRHIRELRMAFARDVISSLQLLFEDGTATRRFGDEHESWASRILTCTVPYGYRLSSWAFREDPGPYRTTAISVLRFQFTPELDIPLPAQYII

SEQ ID NO: 78 - protein, 335 aa, Pellaea falcata
MAAEDVNIVSELAPAANEVQNAEYEEDPIFSQLAQKMVAAAEAGEVPVDLLAQYMQVEAHDWHNRIRGAVLGLISAVPKVGAAISRLIGLFWPANRVDIWEALNAEEYIRNIVQQELFEFEMQLLRNDIEALETTVARYDRAALTEKGNFLSIWISQADALYIRMRNSTNNIHLLLHMVTVSTLHLAALHERLTFGEELYGTNNSANWTQDLVDKFELYTTDLIPSVFKRWKDWRPAQIEITAWVQRGSCGIVTCRPNVSSLQLLFEDGTATRRFGDEHESWASRILTCTVPYGYRLSSWAFREDPGPYRTTAISVLRFQFTPELDIPLPAQYII

SEQ ID NO: 79 - protein, 508 aa, Christella dentata
MDMKDSEMIGGVAPTTLVSEENAETIAEDANNTTVGSEAAGELDKLALEGGDDGIDMLARHMQVEANDWHNRVRDAVLALISDVPMVGTAISILIGLFWPATQVNIWEALKAEVTNIVRREIFEFEMRLLESDIEALERTIVRYERASLLHEKGVFLGHWITQADALAIRMRNSNNRIHLLLHIVTVAVLHMAALHERLTFGEEIYGVNNTANWTTELVEQFERYTSDKVPNIFEEWRPWRESQIEIREWRVAGQCGNLTCRPSVSHATVEDKVSGAKFVFRATNVFSTTIFSDLCRGHRTRMMNEAVADMASCMSPTFAFHTLLPSDIQMQFSPYDRRVFGQVFRGPYSWHLLQHQLFYTSGRISFITQPTLFDRTDRDRILQVTIVEGMISLRGMQFWYDHADPNAMTPGMRAGNFSLAGRPDIIDVDVRNRPIQHLHLEFATDGKFSLQIQFEDGTSTRKFGNGMSPWLGDKVACTTPSGYRLSSWACSPFDLVRFEFTPEIPSS

SEQ ID NO: 80 - protein, 508 aa, Christella dentata
MDMKDSEIIGGVAPTTLVSEENAETIAEDANNTTVGSEAAGELDKLALEGGDDGIDMLARHMQVEANDWHNRVRDAVLALISDVPMVGTAISILIGLFWPATQVNIWEALKAEVTNIVRREIFEFEMRLLESDIEALERTIVRYERASLLHEKGVFLGHWITQADALAIRMRNSNNRIHLLLHIVTVAVLHMAALHERLTFGEEIYGVNNTANWTTELVEQFERYTSDKVPNIFEEWRPWRESQIEIREWRVAGQCGNLTCRPSVSHATVEDKVSGAKFVFRATNVFSTTIFSDLCRGHRTRMMNEAVADMASCMSPTFAFHTLLPSDIQMQFSPYDRRVFGQVFRGPYSWHLLQHQLFYTSGRISFITQPTLFDRTDRDRILQVTIVEGMISLRGMQFWYDHADPNAMTPGMRAGNFSLAGRPDIIDVDVRNRPIQHLHLEFATDGKFSLQIQFEDGTSTRKFGNGMSPWLGDKVACTTPSGYRLSSWACSPFDLVRFEFTPEIPSS

SEQ ID NO: 81 - protein, 508 aa, Christella dentata
MDMKDSEMIGGVAPTTLVSEENAETIAEDANNTTVGSEAAGELDKLALEGGDDGIDMLARHMQVEANDWHNRVRDAVLALISDVPMVGTAISILIGLFWPATQVNIWEALKAEVTNIVRREIFEFEMRLLESDIEALERTIVRYERASLLHEKGVFLGHWITQADALAIRMRNSNNRIHLLLHIVTVAVLHMAALHERLTFGEEIYGVNNTANWTTELVEQFERYTSDKVPNIFEEWRPWRESQIEIREWRVAGQCGNLTCRPSVSHATVEDKVSGAKFVFRATNVFSTTIFSDLCRGHRTRMMNEAVADMASCMSPTFAFHTLLPSDIQMQFSPYDRRVFGQVFRGPYSWHLLQHQLFYTSGRISFITQPTLFDRTDRVRILQVTIVEGMISLRGMQFWYDHADPNAMTPGMRAGNFSLAGRPDIIDVDVRNRPIQHLHLEFATDGKFSLQIQFEDGTSTRKFGNGMSPWLGDKVACTTPSGYRLSSWACSPFDLVRFEFTPEIPSS

SEQ ID NO: 82 - protein, 497 aa, Lastreopsis tinarooensis
MAAPGMEDSKTIADVVTTTVSVPAGEMQDLDQLALDVTNNIDGLAKYMQMEAHDWHNRLRGAILGLISAVPKVGAAISLLIGLFWPANRVDIWVALNAEEYIRNIVKQEIFEFEMQQHQSSIEALEATISRYDRAALTEKGNFLSIWISQADTLSIRLRNSTNNIHLLLHIVTVAVLHIAAMHERLTFGEELYGMNNTVNWKKDLVDVFEMYTSNLVPRLFKEWKEWRERQIEIKAWVVRGVWGNITSTPDVSHATVEDTVSGEKFTFRVTRRNSTTIFSDVCQDHKTRMMNEAIADMASCMSPTFGFHKLLPSDIQAQFSPFDKQLFGQVFRGPYSQDLLQPLFTTLKTFRSRPTRFDQTARDRVLEVTIRAGHHIDAIQFWYDHVNPNSMTAGTMAGNSMGGSRHQVDVRDQRIQDLRLEFSQDVLASLQLHFEDGTSTRKFGNELGWASNIVTCTTPSGYRLSSWAFREDPGPYGTTAISLLRFQFNPEEYPSS

SEQ ID NO: 83 - protein, 497 aa, Lastreopsis tinarooensis
MAAPGMEDSKTIADVVTTTVSVPAGEMQDLDQLALDVTNNIDGLAKYMQMEAHDWHNRLRGAILGLISAVPKVGAAISLLIGLFWPANRVDIWVALNAEEYIRNIVKQEIFEFEMQQHQSSIEALEATISRYDRAALTEKGNFLSIWISQADTLSIRLRNSTNNIHLLLHIVTVAVLHIAAMHERLTFGEELYGMNNTVNWKKDLVDVFEMYTSNLVPRLFKEWKEWRERQIEIKAWVVRGVWGNITSTPDVSHATVEDTVSGEKFTFRVTRRNSTTIFSDVCQDHKTRMMNEAIADMASCMSPTFGFHKLLPSDIQAQFSPFDKQLFGQVFRGPYSQDLLQPLFTTLKTFRSRPTRFDQTARDRVLEVTIRAGHHIDAIQFWYDHVNPNSMTAGTMAGNSMGGSRHQVDVRDQRIQDLRLEFSQDVLASLQLHFEDGTSTRKFGNELGWASNIVTCITPSGYRLSSWAFREDPGPYGTTAISLLRFQFNPEEYPSS

SEQ ID NO: 84 - protein, 518 aa, Asplenium boltonii
MAALDMKDSEMIAGAVAPPTVVFSEEDAEVAATATAVCDPGGEELELDKLALEGGSDGVDLLDKRLQMDAHDWSNRTRNVVLAFISLIPNVGGAVSLLVGFFWPTNKVDIWQALNMEAYVKNIVKQEIFEFEMRQHQSDIEALQNTVQRYDRGSLREKAISLGIWIKDADALSIRLGNSPNRIHLLLHLVTVAVLHMTALHERLTFGKELYGTDNTVNWTKELEEQFVTYMQRRFPEIFAEWKVWRANQIEISEWSRRASGGGIYNPSSSSARVEDKVSGERIDFHVLYQNSTTIFSAICFDHKTRMMNEATADMSSCLSPTFAFHKLLPGYMQSRYAQFVSFTFGQVFRGPYSYDLLQQRFTALKTFRSRPTHFDQTGRNKVLQVNVRSGSLIDALQLVYDHTDQSRTTPGIIVGNSRGGTESVVDVRTRHIQDWRLEFAYDVLVSLQIRFEDGTSTQKFGNVNRWPSRAVTCTTPLGYRLSRWALREDVGPASPTDISLVRFEFTLDDPSRHSLQR

SEQ ID NO: 85 - protein, 518 aa, Asplenium boltonii
MAALDMKDSEMIAGAVAPPTVVFSEEDAEVAATATAVCDPGGEELELDKLALEGGSDGVDLLDKRLQMDAHDWSNRTRNVVLAFISLIPNVGGAVSLLVGFFWPTNKVDIWQALNMEAYVKNIVKQEIFEFEMRQHQSDIEALQNTVQRYDRGSLREKAISLGIWIKDADALSIRLGNSPNRIHLLLHLVTVAVLHMTALHERLTFGKELYGTDNTVNWTKELEEQFVTYMQRRFPEIFAEWKVWRANQIEISEWSRRASGGGIYNPSSSSARVEDKVSGERIDFHVLYQNSTTIFSAICFDHKTRMMNEATADMSSCLSPTFAFHKLLPGYMQSRYAQFVSFTFGQVFRGPYSYDLLQQRFTALKTFRSRPTRFDQTGRNKVLQVNVRSGSLIDALQLVYDHTDQGRTTPGIIVGNSRGGTESVVDVRTRHIQDWRLEFAYDVLVSLQIRFEDGTSTQKFGNVNRWPSRAVTCTTPLGYRLSRWALREDVGPASTTDISLVRFEFTLDDPTRHSLQR

SEQ ID NO: 86 - protein, 524 aa, Campyloneurum xalapense
MAAPGLMSSPVKIADGVHDSVSAPATTEGVPDVVVEDHGIKILPASAEAAVEETDVVVEQPQPVLQLPDYYIEVTADDWHNRIRSAILELSSAIPKVGTAVSFLLGLFWPESKLNIFKSIEMEKYIRNIVKQEIFEFELQQHMSDIEALEDTVKSYDRAALREKGNFLTAWITQSNILATRLRNSANNIHLLLHIVTVATLHMAALHERFTFGKELYQEDNTTNWKADLVAAFRRYAVEVFPNIFKQWKQWRESQVEIATWSRSGGGNINWTPSSSHATVEDKHSGEFIRFVQYYIQSTTIFLTVCEDHKTRMGNEAVADMASYISPTFAFHKLLPDDVRQQHSAYDEEQFGRVFRGPYCKDLLLPNYSASNRDAPEFRSSTNRNDSVTSRHGVVEVTIRTGHHIDAIQFRYGAAGSGTQLGVMAGNSRGGTVRQFDVRRRAIESVRMEFADRYNILAAIQLNFDDGTTTRRLGNELDWPTRVVTCTTPFGYTLSSWAYRQDNGPYSTAAPSVLRFQYAPPIEP

SEQ ID NO: 87 - protein, 524 aa, Campyloneurum xalapense
MAAPGLMSSPVKIADGVHDSVSAPATTEGVPDVVVEDHGIKILPASAEAAVEETDVVVEQPQPVLQLPAYYIEVTADDWHNRIRSAILELSSAIPVVGTGVSFLLGLFWSESKLNIFKSIEMEKYIRNIVKQEIFEFELQQHMSDIEALEDTVKSYDRAALREKGNFLTAWITQSNILATRLRNSANNIHLLLHIVTVATLHMAALHERFTFGKELYQEDNTTNWKADLVAAFRRYAVEVFPNIFKQWKQWRESQVEIATWSRSGGGNINWTPSSSHATVEDKHSGEFIRFVQYYIQSTTIFLTVCEDHKTRMGNEAVADMASYISPTFAFHKLLPDDVRQQHSAYDEEQFGRVFRGPYCKDLLLPNYSASNRDAPEFRSSTNRNDSVTSRHGVVEVTIRTGHHIDAIQFRYGAAGSGTQLGVMAGNSRGGTVRQFDVRRRAIESVRMEFADRYNILAAIQLNFDDGTTTRRLGNELDWPTRVVTCTTPFGYTLSSWAYRQDNGPYSTAAPSVLRFQYAPPIEP

SEQ ID NO: 88 - protein, 507 aa, Colysis ampla
MAATDVNTVSKLAPAAEEVQNADMAEEDPIFSQLAQKMAAAAERGEVPVDLLAKYMQVEAHDWHNRIRGATLGLISAVPKVGAAISKLIGLFWPTNKVDIWEAINAEQYIRNIVQRELFEFEMQLLRNDIEALETTVARYDRAALNAEKGNFLSIWISQADALFIRMRNSTNNIHLLLHMVTVSTLHLAALHERLTFGEELYGTNNSANWTQDLVDKFAAYTTNLIPNVFKRWKDWRPTQIEITASSRRQNCGNLTCRPAMSFAAVEDRMSGAIFSFQATNIQSTTIFSGVCQDHKTRMTNEAIADMASCLSPTFAFHKLLPDDIQARFSPYDREQFGRVFRGPYSEDLSHGFWTVNKAFRSHTTRSDQTARDRILEVIIRAEAHVDAIQFMYDHVNPNATTPGIMAGNPTGSIRYEVDVRDRPIQELRMEFSRNVLASLQLHFQDGTATQKFGNVNGWASRILTCTAPYGYRFSSWAFHEDPGPWATTAISVLRFQFTPELDIPLS

SEQ ID NO: 89 - protein, 507 aa, Colysis ampla
MAATDVNTVSKLAPAAEEVQNADMVEEDPIFSQLAQKMAAAAERGEVPVDLLAKYMQVEAHDWHNRIRGATLGLISAVPKVGAAISKLIGLFWPTNKVDIWEAINAEQYIRNIVQRELFEFEMQLLRNDIEALETTVARYDRAALNAEKGNFLSIWISQADALFIRMRNSTNNIHLLLHMVTVSTLHLAALHERLTFGEELYGTNNSANWTQDLVDKFAAYTTNLIPNVFKRWKDWRPTQIEITASSRRQNCGNLTCRPAMSFAAVEDRMSGAIFSFQATNIQSTTIFSGVCQDHKTRMTNEAIADMASCLSPTFAFHKLLPDDIQARFSPYDREQFGRVFRGPYSEDLSHGFWTVNKAFRSHTTRSDQTARDRILEVIIRAEAHVDAIQFMYDHVNPNATTPGIMAGNPTGSIRYEVDVRDRPIQELRMEFSRNVLASLQLHFQDGTATQKFGNVNGWASRILTCTAPYGYRFSSWAFHEDPGPWATTAISVLRFQFTPELDIPLS

SEQ ID NO: 90 - protein, 507 aa, Colysis ampla
MAATDVNTVSKLAPAAEEVQNADMAEEDPIFSQLAQKMAAAAERGEVPVDLLAKYMQVEAHDWHNRIRGATLGLISAVPKVGAAISKLIGLFWPTNKVDIWEAINAEQYIRNIVQRELFEFEMQLLRNDIEALETTVARYDRAALNAEKGNFLSIWISQADALFIRMRNSTNNIHLLLHMVTVSTLHLAALHERLTFGEELYGTNNSANWTQDLVDKFAAYTTNLIPNVFKRWKDWRPTQIEITASSRRQNCGNLTCRPAMSFAAVEDRMSGAIFSFQATNIQSTTIFSGVCQDHKTRMTNEAIADMASCLSPTFAFHKLLPDDIQARFSPYDRDQFGRVFRGPYSEDLSHGFWTVNKAFRSHTTRSDQTARDRILEVIIRAEAHVDAIQFMYDHVNPNATTPGIMAGNPTGSIRYEVDVRDRPIQELRMEFSRNVLASLQLHFQDGTATQKFGNVNGWASRILTCTAPYGYRFSSWAFHEDPGPWATTAISVLRFQFTPELDIPLS

SEQ ID NO: 91 - protein, 507 aa, Colysis ampla
MAATDVNTVSKLAPAAEEVQNADMAEEDPIFSQLAQKMAAAAERGEVPVDLLAKYMQVEAHDWHNRIRGATLGLISAVPKVGAAISKLIGLFWPTNKVDIWEAINAEQYIRNIVQRELFEFEMQLLRNDIEALETTVARYDRAALNAEKGNFLSIWISQADALFIRMRNSTNNIHLLLHMVTVSTLHLAALHERLTFGEELYGTNNSANWTQDLVDKFAAYTTNLIPNVFKRWKDWRPTQIEITASSRRQNCGNLTCRPAMSFAAVEDRMSGAIFSFQATNIQSTTIFSGVCQDHKTRMTNEAIADMASCLSPTFAFHKLLPDDIQARFSPYDREQFGRVFRGPYSEDLSHGFWTVNKAFRSHTTRSDQTARDRILEVIIRAEARVDAIQFMYDHVNPNATTPGIMAGNPTGSIRYEVDVRDRPIQELRMEFSRNVLASLQLHFQDGTATQKFGNVNGWASRILTCTAPYGYRFSSWAFHEDPGPWATTAISVLRFQFTPELDIPLS

SEQ ID NO: 92 - protein, 550 aa, Asplenium dimorphum
MLSVKQLCKAKNQVVIMAGLDDMKGSEMTAGGVATDPAATDVVSEEDSETTVAEVATATTDVVGEVLELDKLALEGGGGGGGGGGIDVLAKHMQMEAHDWHNRLRGAVLALLSAVPKVGGAISTLVGLFWPANKVNIWEALGLEAYVTNIVLKEIFELEMRLYESDIEALERSILRYERGSLPEKGIALGIWIAQADTLSIRMARSSNRIHLLLHIVTVAVLHMAALHERLEFGEEIYGTNNTANWTKDLEEQFQTYTSDQIPVIFKEWRPWRESQIEIRAWRRRASGNVTFNPNASFATVEDKISGEIFNFSVNFHYSTTIFSDICEAHKTRMMNEANADMASCISPTFAFHNLLPSDGQAKFSPYDRQLFGQVFRGPFSQDLLQPRFTSLKTFRMHPTRSDITVRNRILEVTVRAGSLLEAIRFMYDHLNVNSMTSGILAGNPRGGESFTVDVRGRRIQDLRLEFSRDVLVSLQIRFEDGTSTQKFGNAAGWATSTVTCTTPSGYRLSSWAFREDTGPNATTAISVARYEFTPDDISVPWSIPAPRLL

SEQ ID NO: 93 - protein, 526 aa, Doryopteris cordata
MAAEPDVKHTGSELATPAADEVQKTVPAAAGAEDMQEANEDPIFAQLAQEMQVAAEKGQEVPVVDLIDKYMQVEAHDWHNRVRGAILGLISLVPKVGSAISKLIGLFWPANRVHIWEALRLEQYVRNIVQQEIFDFEMQLLRSDIEALESTVARYDMAALPEKGNFLSIWISQADALYFRLRNSTNNMHLLLHIVTVSTLHMAALHERLIFGEELYGTNNAANWTQDLVTKFRLYTDDLIPSIFKRWKEWREAQIEIRAWVNRGSCGNLVCRPNVSHATVEDKISGARFTFQATNQNSTTIFSAICEDHKTRMVNEAVADMASCLSPTFAFHKLLPDNIQPQFSAYDREQFGQVFRGPYSQDLSHGAWMNLKSFRSRPTSFDQTARDRVLEMNIRAGHHVDAIRFWYDHANSNSMTAGVMAGNPVGGVSHQVDVRGRLIQDLRMEFSHDILAALQLHFLDGTSTRKFGNELGWASRILTCTAPYGYRLSSWAFRQDAGPYGTAAISVLRFQFTPELDFPVPEEYSV

SEQ ID NO: 94 - protein, 526 aa, Doryopteris cordata
MAAEPDVKHTGSELATPAADEVQKTVPAAAGAEDMQEANEDPIFAQLAQEMQVAAEKGQEVPVVDLIDKYMQVEAHDWHNRVRGAILGLISLVPKVGSAISKLIGLFWPANRVHIWEALRLEQYVRNIVQQEIFDFEMQLLRSDIEALESTVARYDMAALQEKGNFLSIWISQADALYFRLRNSSNNMHLLLHIVTVSTLHMAALHERLIFGEELYGTNNAANWTQDLVTKFRLYTVDLIPSIFKRWKEWREAQIEINAWVNRGSCGNLVCRPNVSHATVEDKISGARFTFQATNQNSTTIFSAICEDHKTRMVNEAVADMASCLSPTFAFHKLPPDNIQPQFSAYDREQFGQVFRGPYSQDLSHGAWMNLKSFRSRPTSFDQTARDRVLEVNIRAGHHVDAIRFWYDHANSNSMTAGVMAGNPVGGVSHQVDLRGRLIQDLRMEFSHDILAALQLHFLDGTSTRKFGNELGWASRILTCTAPYGYRLSSWAFRQDAGPYGTAAISVLRFQFTPELDFPVPEEYSV

SEQ ID NO: 95 - protein, 526 aa, Doryopteris cordata
MAAEPDVKHTGSELATPAADEVQKTVPAAAGAEDMQEANEDPIFAQLAQEMQVAAEKGQEVPVVDLIDKYMQVEAHDWHNRVRGAILGLISLVPKVGSAISKLIGLFWPANRVHIWEALRLEQYVRNIVQQEIFDFEMQLLRSDIEALESTVARYDMAALQEKGNFLSIWISQADALYFRLRNSSNNMHLLLHIVTVSTLHMAALHERLIFGEELYGTNNAANWTQDLVTKFRLYTVDLIPSIFKRWKEWREAQIEINAWVNRGSCGNLVCRPNVSHATVEDKISGARFTFQATNQNSTTIFSAICEDHKTRMVNEAVADMASCLSPTFAFHKLLPDNIQPQFSAYDREQFGQVFRGPYSQDLSHGAWMNLKSFRSRPTSFDQTARDRVLEVNIRAGHHVDAIRFWYDHANSNSMTAGVMAGNPVGGVSHQVDLRGRLIQDLRMEFSHDILAALQLHFLDGTSTRKFGNELGWASRILTCTAPYGYRLSSWAFRQDAGPYGTAAISVLRFQFTPELDFPVPEEYSV

SEQ ID NO: 96 - protein, 526 aa, Doryopteris cordata
MAAEPDVKHTGSELATPAADEVQKTVPAAAGAEDMQEANEDPIFAQLAQEMQVAAEKGQEVPVVDLIDKYMQVEAHDWHNRVRGAILGLISLVPKVGSAISKLIGLFWPANRVHIWEALRLEQYVRNIVQQEIFDFEMQLLRSDIEALESTVARYDMAALPEKGNFLSIWISQADALYFRLRNSTNNMHLLLHIVTVSTLHMAALHERLIFGEELYGTNNAANWTQDLVTKFRLYTDDLIPSIFKRWKEWREAQIEIRAWVNRGSCGNLVCRPNVSHATVEDKISGARFTFQATNQNSTTIFSAICEDHKTRMVNEAVADMASCLSPTFAFHKLLPDNIQPQFSAYDREQFGQVFRGPYSQDLSHGAWMNLKSFRSRPTSFDQTARDRVLEVNIRAGHHVDAIRFWYDHANSNSMTAGVMAGNPVGGVSHQVDVRGRLIQDLRMEFSHDILAALQLHFLDGTSTRKFGNELGWASRILTCTAPYGYRLSSWAFRQDAGPYGTAAISVLRFQFTPELDFPVPEEYSV

SEQ ID NO: 97 - protein, 509 aa, Nephrolepis exaltata
MAGYNHVQVSELPPAADQKEQNDATGMAEEDPIFAQLAQKMAAAAEKEEAPVDLLAQYMQVEAHDWHNRIRGAILGLISAVPKVGAAISRLIGLFWPSNKVDIWEALNAEEYIRNIVQQELFEFEMQLLQNDIQALETTVGRYDTAALTEKGNFLSIWISQADALYIRMRNSTNNIHLLLHMVTVSTLHLAALHERLTFGEELYGTNNAANWTQDLVDKFERFTTDLIPTVFRRWKEWRPTQIEITTWVRRGSCGNLTCRPDVSYATVEDKISGALFSFQATNRNSTTIFSEVCEDHKTRMVNEAIADMASCLSPTFAFHKLLPDDIQTQFSPYDRQQFGQVFRGPYSQDLSHGLWTVFKSFRSRTTRSDQTLRDRILEVIIRAGHHVDAIQFVYDHVNPNSTTPGIVAGNAAGGTRHQIDVRDRPIKEVRMEFSQDVLASLQLHFEDGTSTRKFGNELGWATRILTCTVPYGYRFSSWAFREDPGPYRTTAISVLRFQFTPELDMPLP

SEQ ID NO: 98 - protein, 522 aa, Nephrolepis exaltata
MAGYNHVQDQLVMAAAEDVNTVSELAPAADQKEQNDATGMAEEDPIFAQLAQKMAAAAEKEEAPVDLLAQYMQVEAHDWHNRIRGAILGLISAVPKVGAAISRLIGLFWPSNKVDIWEALNAEEYIRNIVQQELFEFEMQLLQNDIQALETTVGRYDTAALTEKGNFLSIWISQADALYIRMRNSTNNIHLLLHMVTVSTLHLAALHERLTFGEELYGTNNAANWTQDLVDKFERYTTDLIPNVFRRWKEWRPTQIEITTWVRRGSCGNLTCRPDVSYATVEDKISGALFSFQATNRNSTTIFSEVCEDHKTRMVNEAIADMASCLSPTFAFHKLLPDDIQTQFSPYDRQQFGQVFRGPYSQDLSHGLWTVFKSFRSRTTRSDQTLRDRILEVIIRAGHHVDAIQFVYDHVNPNSTTPGIVAGNAAGGTRHQIDVRDRPIKEVRMEFSQDVLASLQLHFEDGTSTRKFGNELGWATRILTCTVPYGYRFSSWAFREDPGPYRTTAISVLRFQFTPELDMPLP

SEQ ID NO: 99 - protein, 483 aa, Nephrolepis exaltata
MAEEDPIFAQLAQKMAAAAEKEEAPVDLLAQYMQVEAHDWHNRIRGAILGLISAVPKVGAAISRLIGLFWPSNKVDIWEALNAEEYIRNIVQQELFEFEMQLLQNDIQALETTVGRYDTAALTEKGNFLSIWISQADALYIRMRNSTNNIHLLLHMVTVSTLHLAALHERLTFGEELYGTNNAANWTQDLVDKFERYTTDLIPNVFRRWKEWRPTQIEITTWVRRGSCGNLTCRPDVSYATVEDKISGALFSFQATNRNSTTIFSEVCEDHKTRMVNEAIADMASCLSPTFAFHKLLPDDIQTQFSPYDRQQFGQVFRGPYSQDLSHGLWTVFKSFRSRTTRSDQTLRDRILEVIIRAGHHVDAIQFVYDHVNPNSTTPGIVAGNAAGGTRHQIDVRDRPIKEVRMEFSQDVLASLQLHFEDGTSTRKFGNELGWATRILTCTVPYGYRFSSWAFREDPGPYRTTAISVLRFQFTPELDMPLP

SEQ ID NO: 100 - protein, 483 aa, Nephrolepis exaltata
MAEEDPIFAQLAQKMAAAAEKEEAPVDLLAQYMQVEAHDWHNRIRGAILGLISAVPKVGAAISRLIGLFWPSNKVDIWEALNAEEYIRNIVQQELFEFEMQLLQNDIQALETTVGRYDTAALTEKGNFLSIWISQADALYIRMRNSTNNIHLLLHMVTVSTLHLAALHERLTFGEELYGTNNAANWTQDLVDKFERYTTDLIPNVFRRWKEWRPTQIEITTWVRRGSCGNLTCRPDVSYATVEDKISGALFSFQATNRNSTTIFSEVCEDHKTRMVNEAIADMASCLSPTFAFHKLLPDDIQTQFSPYDRQQFGQVFRGPYSQDLSHGLCTVFKSFRSRTTRSDQTLRDRILEVIIRAGHHVDAIQFVYDHVNPNSTTPGIVAGNAAGGTRHQIDVRDRPIKEVRMEFSQDVLASLQLHFEDGTSTRKFGNELGWATRILTCTVPYGYRFSSWAFREDPGPYRTTAISVLRFQFTPELDMPLP

SEQ ID NO: 101 - protein, 483 aa, Nephrolepis exaltata
MAEEDPIFAQLAQKMAAAAEKEEAPVDLLAQYMQVEAHDWHNRIRGAILGLISAVPKVGAAISRLIGLFWPSNKVDIWEALNAEEYIRNIVQQELFEFEMQLLQNDIQALETTVGRYDTAALTEKGNFLSIWISQADALYIRMRNSTNNIHLLLHMVTVSTLHLAALHERLTFGEELYGTNNAANWTQDLVDKFERFTTDLIPTVFRRWKEWRPTQIEITTWVRRGSCGNLTCRPDVSYATVEDKISGALFSFQATNRNSTTIFSEVCEDHKTRMVNEAIADMASCLSPTFAFHKLLPDDIQTQFSPYDRQQFGQVFRGPYSQDLSHGLWTVFKSFRSRTTRSDQTLRDRILEVIIRAGHHVDAIQFVYDHVNPNSTTPGIVAGNAAGGTRHQIDVRDRPIKEVRMEFSQDVLASLQLHFEDGTSTRKFGNELGWATRILTCTVPYGYRFSSWAFREDPGPYRTTAISVLRFQFTPELDMPLP

SEQ ID NO: 102 - protein, 483 aa, Nephrolepis exaltata
MAEEDPIFAQLAQKMAAAAEKEEVPVDLLAQYMQVEAHDWHNRVRGAILGLISAVPKVGAAISRLIGLFWPANKVDIWEALRAEEYIRNIVQQELFEFEMRLLENDIQALETTVGRYDTAALTEKGNFLSIWISQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCISPTFALHMLLPDDVKTRFSPYDRGLFGRVSRGPYSQDLSHGLWTAFKNFRSRTTRSDQTLRDRILEVIIRAGHHVDAIQFVYDHSNPNLTTPGTVAGNAAGGTRHQVDVRDRPIQELRMEFSQDVLASLQLHFQDGTSTRKFGNELGWATRILTCTAPYGYRFSSWAFREDPGPYRTTAISVLRFQFTPELDMPLP

SEQ ID NO: 103 - protein, 517 aa, Hemionitis arifolia
MAAEDVKSTGSELATPATEELAPAAAVVDMQEAEEDPIFAQLAQEMQVAAAKGQAVDLIDAFMQVQAHDWHNRVRGAILGLLSLVPKVGGAISKLIGLFWPANKVDIWEALKLEEYVRNIVQQEIFDFEMRLLQSDIEALETTIARYDMAALPEKGNFLSIWISQADALYFRMRNSTNNIHLLLHIVTVSTLHLAALHERLTFGEELYGTNNAANWTQDLVNMFRLYTVELIPSVFKRWKEWREAQIEIRAWVNRGSCGVLQCRPDVSHATVEDKISGAIFRFQATNRNSTTIFSAICEDHKTRMVNEAVADMASCLSPTFAFHKLLPVNIQPQFPAFDREQFGQVFRGPYSQDLSHGTWTILKSFRSHPTRFDHTVRDRVLEINIRAGHHVDAIRFWYDHLNPNSMTAGIMAGNASGGVSHQVDMRGRFLQDLRMEFSQDILAALQLHFHDGTSTRKFGNELGWASRILTCTAPYGYRLSSWAFRQDAGPYGTAAISVLRFQFTPELDFPVPEEYS

SEQ ID NO: 104 - protein, 517 aa, Hemionitis arifolia
MAAEDVKSTGSELATPATEELAPAAAVVDMQEAEEDPIFAQLAQEMQAAAAKGQAVDLIDAFMQVQAHDWHNRVRGAILGLLSLVPKVGGAISKLIGLFWPANKVDIWEALKLEEYVRNIVQQEIFDFEMRLLQADIEALETTITRYDMAALPEKGNFLSIWISQADALYFRMRNSTNNIHLLLHIVTVSTLHLAALHERLTFGEELYGTNNAANWTQDLVNMFRLYTVELIPSVFKRWKEWREAQIEIRAWVNRGSCGVLQCRPDVSHATVEDKISGAIFRFQATNRNSTTIFSAICEDHKTRMVNEAVADMASCLSPTFAFHKLLPVNIQPQFPAFDREQFGQVFRGPYSQDLSHGTWTILKSFRSHPTRFDHTVRDRVLEINIRAGHHVDAIRFWYDHLNPNSMTAGIMAGNASGGVSHQVDMRGRFLQDLRMEFSHDILAALQLHFHDGTSTRKFGNELGWASRILTCTAPYGYRLSSWAFRQDAGPYGTAAISVLRFQFTPELDFPVPEEYS

SEQ ID NO: 105 - protein, 517 aa, Hemionitis arifolia
MAAEDVKSTGSELATPATEELAPAAAVVDMQEAEEDPIFAQLAQEMQVAAAKGQAVDLIDAFMQVQAHDWHNRVRGAILGLLSLVPKVGGAISKLIGLFWPANKVDIWEALKLEEYVRNIVQQEIFDFEMRLLQADIEALETTITRYDMAALPEKGNFLSIWISQADALYFRMRNSTNNIHLLLHIVTVSTLHLAALHERLTFGEELYGTNNAANWTQDLVNMFRLYTVELIPSVFKRWKEWREAQIEIRAWVNRGSCGVLQCRPDVSHATVEDKISGAIFRFQATNRNSTTIFSAICEDHKTRMVNEAVADMASCLSPTFAFHKLLPVNIQPQFPAFDREQFGQVFRGPYSQDLSHGTWTILKSFRSHPTRFDHTVRDRVLEINIRAGHHVDAIRFWYDHLNPNSMTAGIMAGNASGGVSHQVDMRGRFLQDLRMEFSHDILAALQLHFHDGTSTRKFGNELGWASRILTCTAPYGYRLSSWAFRQDAGPYGTAAISVLRFQFTPELDFPVPEEYS

SEQ ID NO: 106 - protein, 517 aa, Hemionitis arifolia
MAAEDVKSTGSELATPATEELAPAAAAVDMQEAEEDPIFAKLAQEMQVAAAKGQAVDLIDAYMQVEAHDWHNRVRGAILGLISLVPKVGGAISKLIGLFWPANRVDIWEALKLEEYVRNIVQQEIFDFEMRLLQSDIEALETTIARYDMAALPEKGNFLSIWISQADALYFRMRNSTNNIHLLLHIVTVSTLHLAALHERLTFGEELYGTNNAANWTQDLVNMFRLYTVELIPSVFKRWKEWREAQIEIRAWVIRGGCGVVMCRPDVSHATVEDKISGAIFRFQATNRNSTTIFSAICEDHKTRMVNEAVADMASCLSPTFAFHKLLPVNIQPQFPAFDREQFGQVFRGPYSQDLSHGTWTILKSFRSHPTRFDHTVRDRVLEINIRAGHHVDAIRFWYDHLNPNSMTAGIMAGNASGGVSHQVDMRGRFLQDLRMEFSQDILAALQLHFHDGTSTRKFGNELGWASRILTCTVPYGYRLSSWAFRQDAGPYGTAAISVLRFQFTPELDFPVPEEYS

SEQ ID NO: 107 - protein, 517 aa, Hemionitis arifolia
MAAEDVKSTGSELATPATEELAPAAAVVDMQEAEEDPIFAQLAQEMQVAAAKGQAVDLIDAFMQVQAHDWHNRVRGAILGLLSLVPKVGGAISKLIGLFWPANKVDIWEALKLEEYVRNIVQQEIFDFEMRLLQADIEALETTITRYDMAALPEKGNFLSIWISQADALYFRMRNSTNNIHLLLHIVTVSTLHLAALYERLTFGEELYGTNNAANWTQDLVNMFRLYTVELIPSVFKRWKEWREAQIEIRAWVNRGSCGVLQCRPDVSHATVEDKISGAIFRFQATNRNSTTIFSAICEDHKTRMVNEAVADMASCLSPTFAFHKLLPVNIQPQFPAFDREQFGQVFRGPYSQDLSHGTWTILKSFRSHPTRFDHTVRDRVLEINIRAGHHVDAIRFWYDHLNPNSMTAGIMAGNASGGVSHQVDMRGRFLQDLRMEFSQDILAALQLHFHDGTSTRKFGNELGWASRILTCTVPYGYRLSSWAFRQDAGPYGTAAISVLRFQFTPELDFPVPEEYS

SEQ ID NO: 108 - protein, 443 aa, Pteridium esculentum
MVVASDWNNRIRDTVMKLSSKIPEVGAAVSILIGFLWPQNKVDIFEALKADVLKLVKKQILDYELNLHKSEIDALKITIERYQAAKPNEKAYFLNNWITEADKLSVIFRQSTNNIHLILPVITLALLHLSGLRERLDFGKELYHEDNTKQWEEDLEEMYKTYIVNFLPDVFKKWKVWRADQVEINAWTEPHPTAIPPFFRIESHATVVDTITGEKKHFSADLTDSKTIFASVCQDHKTRMCNDATADMAGCISATFVFDKLLSDNKKNLPKYDKGVFGRMFRGPYSQDLLLSEQNFGFGNPVKIFRTRPDQDDNSPSSGPITKVIIREWNTVDAMQLIYANRQGRLAGNAGGGQRHDIDVTGKLVSGLHMGFSNGVLTFVQLLYYDGTSSSKYGNRSGWTCYEVSANGPPAYRVSSWSYKEDRGPSNTYGPSVIQLEYTPQIE

SEQ ID NO: 109 - protein, 443 aa, Pteridium esculentum
MVVASDWNNRIRDTVMKLSSKIPEVGAAVSILIGFLWPQNKVDIFEALKADVLKLVKKQILDYELNLHKSEIDALKITIERYQAAKPNEKAYFLNNWITEADKLSVIFRQSTNNIHLILPVITLALLHLSGLRERLDFGKELYHEDNTKQWEEDLEEMYKTYIVNFLPDVFKKWKVWRADQVEINAWTEPHPTAIPPFFRIESHATVVDTITGEKKHFSADLTDSKTIFASVCQDHKTRMCNDATADMAGCISATFVFDKLLSDNKKNLPKYDKGVFGRMFRGPYSQDLLLSEQNFGFGNPVKIFRTRPDQDDNSPSSGPITKVIIREWNTVDAMQLIYANRQGRLAGNAGGGQRHDIDVTDKLVSGLHMGFSNGVLTFVQLLYYDGTSSSKYGNRSGWTCYEVSANGPPAYRVSSWSYKEDRGPSNTYGPSVIQLEYTPQIE

SEQ ID NO: 110 - protein, 511 aa, Pellaea falcata
MAAKNDVSELAPAADDEVQNADEEDPIFSQLAQKMVAAAEAGEVPVVDLLAQYRHVEAHDWHNRIRGAVLALIALVPKVGAAISKLVGLFWPANRVNIWEALNAEQYIRNIVQQEIFEFEMQLLRSDIQALETTVARYDRAAALNEKGNFLSIWISQADALYSRMRNSANNIHLLLHMVTVSTLHLAALHERMTFGQELYGTNNSANWTQDLVDKFALYTTDLIPSVFKRWKDWRPTQIEITAWTRPGSCSNVMGCGPNMSYARVEDKVSGAIFTFQARNQLSTTIFSGICQDHRTRMVNEAIADMASCLSPTFAFHRLLPAYIQPRFSAFDREQFGQVFRGPYSEDLSHGAWFHLKAFRSHTTRSDQTNRDRILQVIIRAGHHVDAIQFMYDHANSNALTPGIIAGNSAGGNRHEVNVRDPPMQELRMEFAHDVLASLQIHFEGGTSTRRFGNELGWASSILTCTAPYGYRFSSFAFREDTGPYRTTAISVLRFQFTPELDIPLPAQYII

SEQ ID NO: 111 - protein, 510 aa, Pellaea falcata
MAAKNDVSELAPAADEVQNADEEMDPIFSQLAQKMVAAAEAGEVPVVDLLAQYMQVEAHDWHNRIRGAVLGLISAVPKVGAAISRLIGLFWPANRVDIWEALNAEEYIRNIVQQELFEFEMQLLRNDIEALETTVARYDRAALNEKGNFLSIWISQADALYIRMRNSTNNIHLLLHMVTVSTLHLAALHERLTFGEELYGTNNSANWTQDLVDKFELYTTDLIPSVFKRWKDWRPTQIEITAWTRRGTCSNVTGCNPNFSYATVEDKVSGAIFTFQARNQLSTTIFSAVCQDHKTRMVNEAIADMASCLSPTFAFHRLLPNDIQPRFSAYDREQFGQVFRGPYSQDLSHGAWMNHKAFRSHTTRSDQTNRDRILQVIIRAGHHVDAIQFMYDHANSNALTPGIIAGNSAGGIRHQVDVRDPPMQELRMEFSHDVLASLQIHFEDGTSTRRFGNELGWATRILTCTAPYGYRFSSWAFREDAGPYGTTAISVLRFQFTPELDIPLPAQYII

SEQ ID NO: 112 - protein, 510 aa, Pellaea falcata
MAAKNDVSELAPAAADEVQNADEEDPIFSQLAQKMVAAAEAGEVPVVDLLAQYMQVEAHDWHNRIRGAVLALIALVPKVGAAISWLIGLFWPANRVDIWVALNAEQYIRNIVHQELFEFEMQLLWNDIEALETTVARYDRAALTEKGNFLSIWISQADALFIRMRNSANNIHLLLHMVTVSTLHLAALHERLTFGEELYGTNNSANWTRDLVDKFELYTTDLFPSVFKRWKDWRPTQIEITAWTRRGSCGNLICRPNVSYARVEDKVSGAIFSFQATNQLSTTIFSGICQDHKTRMVNEAIADMASCLSPTFAFHRLLPDDIQPRFSAFDREQFGQVFRGPYSQDLSHGAWTILKAFRSHTTRSDQTNRDRILEMIIRAGSHVDAIQFMYDHANPNAMTAGIMAGNPTGGNRHHVDVRGRPIRELRMAFARDVMSSLQLHFEDGTATRRFGDEHQSWASRILTCTVPYGYRLSSWAFREDPGPYRTTAISVLRFQFTPELDIPLPAQYII

SEQ ID NO: 113 - protein, 484 aa, Ophioglossum pendulum
MAEEDPIFTQLAQKMAAAAAKEEVPVDLLAQYMQVEAHDWHNRVRGAILGLISAVPKVGAAISRLIGLFWPANKVDIWEALKLEEYIRNIVQQELFEFELRLLENDIQALETTVGRYDTAALTEKGNFLSIWISQADALYIRMRNSTNNIHLLLHMVTVSTLHLAALHERLTFGEELYGTNNSANWTQDLVDKFERYTTDLIPNVFKRWKEWRPTQIEIRAWVRRGSCGNLTCRPDVSYATVEDKISGALFSFQATNRNSTTIFLEVCEDHKTRMVNEAIADMASCLSPTFAFHKLLPDNIQAQFSPYDRQQFGQVLRGPYSQDLSHGLWTVFKSFRSRTTRSDQTLRDRILEVIIRAGHHVDAIQFVYDHANPNLTTSGTVAGNATGGSRHQVDVRDRPIQEVRMEFSQDVLASLQLHFEDGTSTRKFGNELGWATRILTCTAPYGYRFSSWAFREDPGPYRTTAISVLRFQFTPELDMPLPI

SEQ ID NO: 114 - protein, 484 aa, Ophioglossum pendulum
MAEEDPIFTQLAQKMAAAAAKEEVPVDLLAQYMQVEAHDWHNRVRGAILGLISAVPKVGAAISRLIGLFWPANKVDIWEALKLEEYIRNIVQQELFEFELRLLENDIRALETTVGRYDTAALTEKGNFLSIWISQADALYIRMRNSTNNIHLLLHMVTVSTLHLAALHERLTFGEELYGTNNSANWTQDLVDKFERYTTDLIPNVFKRWKEWRPTQIEIRAWVRRGSCGNLTCRPDVSYATVEDKISGALFSFQATNRNSTTIFLEVCEDHKTRMVNEAIADMASCLSPTFAFHKLLPDNIQAQFSPYDRQQFGQVLRGPYSQDLSHGLWTVFKSFRSRTTRSDQTLRDRILEVIIRAGHHVDAIQFVYDHANPNLTTSGTVAGNATGGSRHQVDVRDRPIQEVRMEFSQDVLASLQLHFEDGTSTRKFGNELGWATRILTCTAPYGYRFSSWAFREDPGPYRTTAISVLRFQFTPELDMPLPI

SEQ ID NO: 115 - protein, 486 aa, Selliguea feei
MGADTVASDWNNRIRDVVIKLAGKIPEVGSVVSVLIGMFWPENKINVFDALKADLAKLVKKEILDYELNLSQSQINGLKIVIQRYKEAKNHEKGALLGIWITRADELSVQFRESTNNIHLILLVINLAVLHLAGLRERLDFGKELYNEDNTEQWRKDLEKVYSTYIVDFLPKIFKQWQVWRADQIQIKAWTEKHPVPPFFRSESYASTEDTITGEKKNFYVDMTSSLEVFKEICNAHKTRMCNDASSDMAGCIATTFEFYKMLPENSKNFPKYDKDVFGRMFKGPYSEDLYWPQRSYGLGNSVSIFRVNPNEDDYSPNSGPITKMVIGEWNSFDAKRRVYYANREEMLADNPRGGKRHEIDVTYMPRIEWYSNAMQFVYANCKGKLAGNPQRRKWHFIDVTNKPINGFVLGFSSGVLVSVQINYYDGSSSSTYGNSRGWPINAASPKGPPVYKLSSWSYKEYKHSSGPSRTCGPSVVQLEYAPQIE

SEQ ID NO: 116 - protein, 446 aa, Selliguea feei
MGADTVASDWNNRIRDVVIKLAGKIPEVGSVVSVLIGMFWPENKINVFDALKADLAKLVKKEILDYELNLSQSQINGLKIVIQRYKEAKNHEKGALLGIWITRADELSVQFRESTNNIHLILLVINLAVLHLAGLRERLDFGKELYNEDNTEQWRKDLEKVYSTYIVDFLPKIFKQWKVWRADQIQIKAWTEAHPTAIPPFFRMESYASTEDTMTGEKKNFSVDLTSSLEVFKEICNAHKTRMCNDASSDMAGCIATTFEFYKMLPKNSKNFPKYDKDVFVRMFKGPYSEDLYWQQEGYGLGNPVPVFRVNPDQDDYSPNSGPITKMVIREWNSIDAMQFVYANREGKLAGNARGGERHDIDVTNKPINGLVLGFSSGVLASVKINYYDGSSSSTYGNRGGWQICGASPKGPPVYKLSSWSYKEDYGPSGTYGPSVVQLEYAPQIE

SEQ ID NO: 117 - protein, 486 aa, Selliguea feei
MGADTVASDWNNRIRDVVIKLAGRIPEVGSAVSVLIGMFWPVNLIDVFEALKADLTNLIKKEILDYELNLSQSQIKGLKIVLQRYKGAKNHEKGALLDLWITQADQLNVQFRESTNNIHLILLVINVAVLHLAGLRERLDFGKELYNEDNTEQWREDLEKVYSTYIVDFLPKIFKQWQVWRADQIQIKAWTEKHPVPPFFRSESYASTEDTITGEKKNFYVDMTSSLEVFKEICNAHKTRMCNDASSDMAGCIATTFEFYKMLPENSKNFPKYDKDVFGRMFKGPYSEDLYWPQRSYGLGNSVSIFRVNPNEDDYSPNSGPITKMVIGEWNSFDAKRRVYYANREEMLADNPRGGKRHEIDVTYMPRIEWYSNAMQFVYANCKGKLAGNPQRRKWHFIDVTNKPINGFVLGFSSGVLVSVQINYYDGSSSSTYGNSRGWPINAASPKGPPVYKLSSWSYKEYKHSSGPSRTCGPSVVQLEYAPQIE

SEQ ID NO: 118 - protein, 446 aa, Selliguea feei
MGADTVASDWNNRIRDVVIKLAGKIPEVGSVVSVLIGMFWSENKINVFDALKADLAKLVKKEILDYELNLSQSQINGLKIVIQRYKEAKNHEKGALLGIWITRADELSVQFRESTNNIHLILLVINLAVLHLAGLRERLDFGKELYNEDNTEQWRKDLEKVYSTYIVDFLPKIFKQWKVWRADQIQIKAWTEAHPTAIPPFFRMESYASTEDTMTGEKKNFSVDLTSSLEVFKEICNAHKTRMCNDASSDMAGCIATTFEFYKMLPKNSKNFPKYDKDVFVRMFKGPYSEDLYWQQEGYGLGNPVPVFRVNPDQDDYSPNSGPITKMVIREWNSIDAMQFVYANREGKLAGNARGGERHDIDVTNKPINGLVLGFSSGVLASVKINYYDGSSSSTYGNRGGWQICGASPKGPPVYKLSSWSYKEDYGPSGTYGPSVVQLEYAPQIE

SEQ ID NO: 119 - protein, 446 aa, Selliguea feei
MGADTVASDWNNRIRDVVIKLAGKIPEVGSVVSVLIGMFWPENKINVFDGLKADLAKLVKKEILDYELNLSQSQINGLKIVIQRYKEAKNHEKGALLGIWITRADQLSVQFRESINNIHLILLVINLAVLHLAGLRERLDFGKELYNEDNTEQWRKDLEKVYSTYIVDFLPKVFKLWKVWRADQIQIKAWTEAHPTAIPPFFRLESYASTEDTITGEKKNFSVDLTSSLEVFKKICNAHKTRMCNDASSDMAGCIATTFEFYKMLPKNNKNLPKYDKDVFGRMFKGPYSEDLYWPQRGYGLGNPVPVFRVNPDKDDYSPNSGPITKMVIREWNSIDAMQFVYTNREGKLAGNPRGGKRHDIDVTNKPINGLVLGFSSGVLASVKINYYDGSSSSTYGNRGGWPIYAASPKGPPVHKLRSWSYKEDYGPSRTYGPSVVQLEYAPQIE

SEQ ID NO: 120 - protein, 487 aa, Polypodium glycyrrhiza
MQIEGKSLLTLIALSLYSLSTHTLSLSLSLTTLFFSWTQKYMIAAPPSAKDLQDNQLAAQEKMTAHDDDDNNTMKVSAPPVNNIAAAAAPAGDNVEELDQLGVDVLARNMQIEAHDWQNRLRRSIMTLASMIPKVGGAVSLLIGLFWPANKVDIWEAINGEEYVRNIVQQEIFEFELQQLRSDIEALEATVSRYNTAALTEKGNFLSIWISQADALSIRMRNSSNNIHLLLHLVTVAVLHVAALHERLTFGEELYGSNHTASWTQDLVNLFQLYTSDVVPKLFREWRQWRESQIEIKAWVVRGAWGNLVQRPDVSHATVEDKISREMFTFRETRRNSTTIFSDVCQDHKTRMMNEAIADMASCMSPTFAFHKLLPDDIQTQLPPYDKELFEQVFRGPYSQDLLQKLFTTLKAFRSRPTRFDQTARNRILEVVVRAGHHVDAIQFWYDHVNSNGMTAGTMAGNPRGGVGIWLTGIGPYMNYAWSSLMT

SEQ ID NO: 121 - protein, 499 aa, Tectaria antioquoiana
MAAPGMKDSGVIADVDVATTVSDVPTKELQDLDQLALQDVSKNIDALAKYMQMEAHDWHNRVRGAVLGIIAAIPKVGAAVSRLIGLFWPTNKVDIWVALNAEEYVRNIVRQEIFEFEMQQHKSEIEALEAAISRYERAAIAEKGNFLSIWIWQADRLCIQLRNSSNNIHLLLHIVTVSVLHIAAMHERLAFGEEIYGTNNTAAWRKDFVDVFQMYTSNLIPNLFKQWRQWRESQIEIRAWVVRGVWGNITSTPDVSHATVEDKISGEIFRFRVARRNSTTIFSDVCQDHRTRMLNEAVADMAACISPTFGFHKLLPTDIQTQYSPYDKELFAQVFRGPYSQDLLQPLFTTLKTFRSRPTRFDQTARDRILEMTIRSGHHVDAIQFWYDHANSNAMTAGIMGGNSTGGSRHQVDVRNQRIHDLRLEFSHDVLASLQLHFEDGTSTRKFGNELWWASDIVTCTTPSGYRLSSWAFREDPGPYNTTAISLLRFQFTHDDISS

SEQ ID NO: 122 - protein, 512 aa, Tectaria antioquoiana
MAAPGMKDSGVIADVDVATTVSDVPTKELQDLDQLALQDVSKNIDALAKYMQMEAHDWHNRVRGAVLGIIAAIPKVGAAVSRLIGLFWPTNKVDIWVALNAEEYVRNIVRQEIFEFEMQQHKSEIEALEAAISRYERAAIAEKGNFLSIWIWQADRLCIQLRNSSNNIHLLLHIVTVSVLHIAAMHERLAFGEEIYGTNNTAAWRKDFVDVFQMYTSNLIPNLFKQWRQWRESQIEIRAWVVRGVWGNITSTPDVSHATVEDKISGEIFRFRVARRNSTTIFSDVCQDHRTRMLNEAVADMAACISPTFGFHKLLPTDIQTQYSPYDKELFAQVFRGPYSQDLLQPLFTTLKTFRSRPTRFDQTARDRILEMTIRSGHHVDAIQFWYDHANSNAMTAGIMGGNSTGGSRHQVDVRNQRIHDLRLEFSHDVLASLQLHFEDGTSTRKFGNELWWASDIVTCTTPSGYRLSSWAFREDPGPYNTTAISLLRFQFTPDDIHPNLDLSIFWIGQLN

SEQ ID NO: 123 - protein, 499 aa, Tectaria antioquoiana
MAAPGMKDSGVIADVDVATTVSDVPTKELQDLDQLALQDVSKNIDALAKYMQMEAHDWHNRVRGAVLGIIAAIPKVGAAVSRLIGLFWPTNKVDIWVALNAEEYVRNIVRQEIFEFEMQQHKSEIEALEAAISRYERAAIAEKGNFLSIWIWQADRLCIQLRNSSNNIHLLLHIVTVSVLHIAAMHERLAFGEEIYGTNNTAAWRKDFVDVFQMYTSNLIPNLFKQWRQWRESQIEIRAWVVRGVWGNITSTPDVSHATVEDKISGEIFRFRVARRNSTTIFSDVCQDHRTRMLNEAVADMAACISPTFGFHKLLPTDIQTQYSPYDKELFAQVFRDPYSQDLLQPLFTTLKTFRSRPTRFDQTARDRILEMTIRSGHHVDAIQFWYDHANSNAMTAGIMGGNSTGGSRHQVDVRNQRIHDLRLEFSHDVLASLQLHFEDGTSTRKFGNELWWASDIVTCTTPSGYRLSSWAFREDPGPYNTTAISLLRFQFTPDDISS

SEQ ID NO: 124 - protein, 499 aa, Tectaria antioquoiana
MAAPGMKDSGVIADVDVATTVSDVPTKELQDLDQLALQDVSKNIDALAKYMQMEAHDWHNRVRGAVLGIIAAIPKVGAAVSRLIGLFWPTNKVDIWVALNAEEYVRNIVRQEIFEFEMQQHKSEIEALEAAISRYERAAIAEKGNFLSIWIWQADRLCIQLRNSSNNIHLLLHIVTVSVLHIAAMHERLAFGEEIYGTNNTAAWRKDFVDVFQMYTSNLIPNLFKQWRQWRESQIEIIAWVVRGVWGNITSTPDVSHATVEDKISGEIFRFRVARRNSTTIFSDVCQDHRTRMLNEAVADMAACISPTFGFHKLLPTDIQTQYSPYDKELFAQVFRGPYSQDLLQPLFTTLKTFRSRPTRFDQTARDRILEMTIRSGHHVDAIQFWYDHANSNAMTAGIMGGNSTGGSRHQVDVRNQRIHDLRLEFSHDVLASLQLHFEDGTSTRKFGNELWWASDIVTCTTPSGYRLSSWAFREDPGPYNTTAISLLRFQFTPDDISS

SEQ ID NO: 125 - protein, 454 aa, Nephrolepis cordifolia
MGSEKLHVATEIVIGDWNNRIRDTIMKISSKIPEVGVVVSTLIGFFWPENKVDIFEALKVDITKLVKKEVLDYEVNLHHSEINALKTIMGRYKGAKMHEKGNFLSNWITEADKLSVIFRESANSIHLILPVITLALLHLTGLRERLDFGRELYGEDNTRQWKQDLEEMYKTYIVDFLPNTFKKWKVWRANQVEINGWTETHPTAIPPFFRKESHATVVDTITGEKKHYSVDLTESKSIFQRVCEDHKTKMCNEAAADMAGCISASFMFYKLLPADSNKNFPKYDKAVFGRIFRGPYSEDLFSSDRNFGFGYPVPVFRTRPNYDDYSPNSGPITKVIVREWNTIDAMQFVYANRQGNLAGNARGGQRHEIDVTGKPIGGLRMGFSNGVLTYVQIIYLDGTFSSTFGNRSGWACHEASPKCPSAYRVSSWSYKVDSGPSNTSGPSTIQLEYAPQME

SEQ ID NO: 126 - protein, 454 aa, Nephrolepis cordifolia
MGSEKLHVATEIVIGDWNNRIRDTIMKISSKIPEVGVVVSTLIGFFWPENKVDIFEALKADITKLVKKEVLDYEVNLHHSEINALKTIMGRYKGAKMHEKGNFLSNWITEADKLSVIFRESANSIHLILPVITLALLHLTGLRERLDFGRELYGEDNTRQWKQDLEEMYKTYIVDFLPNTFKKWKVWRANQVEINGWTETHPTAIPPFFRKESHATVVDTITGEKKHYSVDLTESKSIFQRVCEDHKTKMCNEAAADMAGCISASFMFYKLLPADSNKNFPKYDKAVFGRIFRGPYSEDLFSSDRNFGFGYPVPVFRTRPNYDDYSPNSGPITKVIVREWNTIDAMQFVYANRQGNLAGNARGGQRHEIDVTGKPIGGLRMGFSNGVLTYVQIIYLDGTFSSTFGNRSGWACHEASPKCPSAYRVSSWSYKVDSGPSNTSGPSTIQLEYAPQME

SEQ ID NO: 127 - DNA, 1578 bp, Pteris albolineata
atggattccgatctgattgctcagcctcctgacgataacgctgcttctgtgggtgccccggctgcagagaaggttcaggaggatcagttggtagtgacaacgccagaaatggaggactcagacgttgatccgcaattcgaacaagaaatgatcaatatttctgcgcttatcgctgctggtgcagtggaggggcacgacgacgtagatcttttcgccaaatacatgcaggtcgaggctcatgactggcagaaccggcttagacaagctatactggggctaacgcttgcaatcccaaacccaattgtgggtttagcgataagtgggttcatccgcctcctttggccagcaaacaaggtaagtatttgggaggctctcaatgcggagcaatacattacgaacattgtccagcaggagctgatgcaattcgaaatgcggacacttcagtcccgaatcgaggcgctgcaaaccacaattcacagatacgatcaggccgctgcaactactgagaaggggaactttctaagtaactggatcactcaagctgatggtttgctttctagcatgcgcaattcttccaacaggatccaccttctccttcacattgtcaccgtggctgcgctccatatggcagctctgcatgagcgactgacttttggcgaggaactctacggcttaaacgatacagcaagttggcagcgagctctggtggaaatgtttgaggagtacacgatcaaattaatcccgaccatctttaaggagtggaggccgtggcgggaacgccagattgagattaacgaatggagacagaggggtcaatcgggcgtaactatatttcgtccagactcttcccatgctaccgtgcaggataagctctcaggggaacttttcacatttcgggtgaactatcaatactcgacaacaattttctctggagtgaccagagatcataggactcggatgattaatgaggcaattgcggacatggctagctgcatatcacccacttttgctctccacatgctcctacctgatgatgtcaagacacggttttctccttatgacagggggttattcggccgggtgagcagaggcccatattctcaggatcttcttcagcaacttttcacgagtgtgaaagacttcagatcgcatccaagacgctttgatcagacggctcgtgaccgagtcgtgaaggtgattataagagcgggtcaccacgttgatgctatacaattttggtacgatcatgtgaattcaaattctacaactacaggcattatggctggaaattctagtggggggattaggcatgagattgacgtgaaggaccggcccatacacgagttgcgcatggagttttctcacaacgtgctcgcttcattgcaacttcatttccaagatggtacagcaacgcaaaaatttggcaatgtaaatggttgggcatctagaatagccacttgcacagccccctatagctacaagcttagctcatgggcctttcgtgaagatcccggcccctataatacgacagccatcagtgtacttcgcttcgatttcacacctgaagatccctcatca

SEQ ID NO: 128 - DNA, 1581 bp, Pteris albolineata
atggattccgatctgattgctgagcctcatgacggtaacgccgcttctgtgggtgccccggctgcagagaaggttcaggaggatcagttggtagctgtgacaacgccagaaatggaggactcagacgttgatccgcaattcgaacaagaaatgatcaatatttctgcgcttatcgctgctggtgcagtggaggggcacgacgacttagatcttttcgccaaatacatgcaggtcgatgctcatgactggcataaccggcttagacaagctatactggggctaacgcttgcaattccaaacccagttgtgggtttagcgataagtgggttcatccgcctcatttggccaccaaacaaggtaagtatttgggacgctctcaatgcggagcaatacattacgaacattgtccagcaggagctgatgcaatccgaaatgcggacacttcagtcccgaatcgaggcgctgcaaaccacaatttacagatacgatcaggccgctgcaactactgagaaggggacctttctaagcatctggatctctcaagctgatggtttgctttctagcatgcgcaattcttccaacaggatccaccttctccttcacattgtcaccgtggctgtgctgcatatggcagctctgcatgagcggctgacttttggcgaggaactatacggcttaaacgatacagcaagttggaagcgagctctggtggaaatgtttgaggagtacacgatcaaattaatcccgactatctttaaggagtggaggccgtggcgggaacgccagattgagattaacgaatggagacagaggggtcaatcgggcgtaactatatttcgtccagactcttcgcatgctaccgtgcaggataagctctcaggagaacttttcacatttcgggtgaactatcaatactcgacaacaattttctctggagtgaccagagatcataggactcgaatgattaatgaggcaattgcggacatggctagctgcatatcacccacttttgctctccacatgctcctacctgatgatgtcaagacacggttttctccttatgacaaggagttattcggccgggtgaggagaggcccatattctcaagatcttcttcagcaacttttcacgagtgtgaaagacttcagatcgcatccaagacgctttgatcagacggctcgtgaccgagtcgtgaaggtgattataagagcgggtcaccacgttgatgctatacaattttggtacgatcatgtgaattcaaattctacaactacaggcattatggctggaaattctagtggggggattaggcatgagattgacgtgaaggaccggcccatacacgagttgcgcatggagttttctcacaacgtgctcgcttcattgcaacttcatttccaagatggtacagcaacgcaaaaatttggcaatgtaaatggttgggcatctagaatagccacttgcacagccccctatagctacaagcttagctcatgggcctttcgtgaagatcccggcccctataatacgacagccatcagtgtacttcgcttcgatttcacacctgaagatccctcatca

SEQ ID NO: 129 - DNA, 1578 bp, Pteris albolineata
atggattccgatctgattgctcagcctcctgacgataacgctgcttctgtgggtgccccggctgcagagaaggttcaggaggatcagttggtagtgacaacgccagaaatggaggactcagacgttgatccgcaattcgaacaagaaatgatcaatatttctgcgcttatcgctgctggtgcagtggaggggcacgacgacttagatcttttcgccaaatacatgcaggtcgatgctcatgactggcataaccggcttagacaagctatactggggctaacgcttgcaattccaaacccagttgtgggtttagcgataagtgggttcatccgcctcatttggccaccaaacaaggtaagtatttgggacgctctcaatgcggagcaatacattacgaacattgtccagcaggagctgatgcaatccgaaatgcggacacttcagtcccgaatcgaggcgctgcaaaccacaatttacagatacgatcaggccgctgcaactactgagaaggggacctttctaagcatctggatctctcaagctgatggtttgctttctagcatgcgcaattcttccaacaggatccaccttctccttcacattgtcaccgtggctgtgctgcatatggcagctctgcatgagcggctgacttttggcgaggaactatacggcttaaacgatacagcaagttggaagcgagctctggtggaaatgtttgaggagtacacgatcaaattaatcccgactatctttaaggagtggaggccgtggcgggaacgccagattgagattaacgaatggagacagaggggtcaatcgggcgtaactatatttcgtccagactcttcgcatgctaccgtgcaggataagctctcaggagaacttttcacatttcgggtgaactatcaatactcgacaacaattttctctggagtgaccagagatcataggactcgaatgattaatgaggcaattgcggacatggctagctgcatatcacccacttttgctctccacatgctcctacctgatgatgtcaagacacggttttctccttatgacaaggagttattcggccgggtgaggagaggcccatattctcaagatcttcttcagcaacttttcacgagtgtgaaagacttcagatcgcatccaagacgctttgatcagacggatcgtgacaaagtcatgcaggtgattataagggcgcaacaccatgttgatgctatacaattttggtacactcgtgcgaatctaaattctataagtccaggcattatggctggaaattatagtggggggattaggtatgacattaacgtgagggaccgtcccatacaggagttgcgcatggagttttctcgcgacgtgcttgcttcattgcaacttcatttccaagatggtacagcaacgcagaaatttggcaatgtaaatggttgggcaactagaatagccacttgcacagccccctacagctacaagcttagctcatgggcctttcgtgaagatcccggccccaatgggacgacagccatcagtgtacttcgctttgatttcacacctgaagatccctcatca

SEQ ID NO: 130 - DNA, 1581 bp, Pteris albolineata
atggattccgatctgattgctgagcctcatgacggtaacgccgcttctgtgggtgccccggctgcagagaaggttcaggaggatcagttggtagctgtgacaacgccagaaatggaggactcagacgttgatccgcaattcgaacaagaaatgatcaatatttctgcgcttatcgctgctggtgcagtggaggggcacgacgacttagatcttttcgccaaatacatgcaggtcgatgctcatgactggcataaccggcttagacaagctatactggggctaacgcttgcaattccaaacccagttgtgggtttagcgataagtgggttcatccgcctcatttggccaccaaacaaggtaagtatttgggacgctctcaatgcggagcaatacattacgaacattgtccagcaggagctgatgcaatccgaaatgcggacacttcagtcccgaatcgaggcgctgcaaaccacaatttacagatacgatcaggccgctgcaactactgagaaggggacctttctaagcatctggatctctcaagctgatggtttgctttctagcatgcgcaattcttccaacaggatccaccttctccttcacattgtcaccgtggctgtgctgcatatggcagctctgcatgagcggctgacttttggcgaggaactatacggcttaaacgatacagcaagttggaagcgagctctggtggaaatgtttgaggagtacacgatcaaattaatcccgactatctttaaggagtggaggccgtggcgggaacgccagattgagattaacgaatggagacagaggggtcaatcgggcgtaactatatttcgtccagactcttcgcatgctaccgtgcaggataagctctcaggagaacttttcacatttcgggtgaactatcaatactcgacaacaattttctctggagtgaccagagatcataggactcgaatgattaatgaggcaattgcggacatggctagctgcatatcacccacttttgctctccacatgctcctacctgatgatgtcaagacacggttttctccttatgacaaggagttattcggccgggtgaggagaggcccatattctcaagatcttcttcagcaacttttcacgagtgtgaaagacttcagatcgcatccaagacgctttgatcagacggatcgtgacaaagtcatgcaggtgattataagggcgcaacaccatgttgatgctatacaattttggtacactcgtgcgaatctaaattctataagtccaggcattatggctggaaattatagtggggggattaggtatgacattaacgtgagggaccgtcccatacaggagttgcgcatggagttttctcgcgacgtgcttgcttcattgcaacttcatttccaagatggtacagcaacgcagaaatttggcaatgtaaatggttgggcaactagaatagccacttgcacagccccctacagctacaagcttagctcatgggcctttcgtgaagatcccggccccaatgggacgacagccatcagtgtacttcgctttgatttcacacctgaagatccctcatca

SEQ ID NO: 131 - DNA, 1578 bp, Pteris umbrosa
atggattccgatctgattgctcagcctcatgacgataacgctgcttctgtgggtgcccctgctgcagagaaggttcacgaggatcagttggtagtgacaacgccagaaatggaggactcagacgttgatccgcaattcgaacaagaaatgatcaatatttctgcgcttatcgctgctggtgcagtggaggggcacgacgacgtagatcttttcgccaaatacatgcaggtcgaggctcatgactggcagaaccggcttagacaagctatactggggctaacgcttgcaatcccaaacccaattgtgggtttagcgataagtgggttcatccgcctcctttggccagcaaacaaggtaagtatttgggaggctctcaatgcggagcaatacattacgaacattgtccagcaggagctgatgcaattcgaaatgcggacacttcagtcccgaatcgaggcgctgcaaaccacaattcacagatacgatcaggccgctgcaactactgagaaggggaactttctaagcaactggatctctcaagctgatggtttgctttctagcatgcgcaattcttccaacaggatccaccttctccttcacattgtcaccgtggctgtgctccatatggcagctctgcatgagcgactgacttttggcgaggaactctacggcttaaacgatacagcaagttggaagcgagctctggtggaaatgtttgaggagtacacgatcaaattaatcccgactatctttaaggagtggaggccgtggcgggaacgccagattgagattaacgaatggagacagaggggtcaatcgggcattaatacacatcgtccaaactcttcgcatgctaccgtgcaggataagctctcaggggaacttttcacatttcgggtgaactatcaatactcgacaacaattttctctagagtgaccagagatcataggattcggatgattaatgaggcaattgcagacatggctagttgtatatcacccacttttgctctccacatgctcctacctgatgatgtcaagacacggttttctccctatgacaagcagttatttagccgggtgagcagaggcccatattctcaggatcttcttcaacaacttttcacgaatgtgaaagacttcagatcacagccaattcgcgctgatcagacggctcgtgacagagtcgtgaaggtgattataagggcgcggcaccacgttgatgctatacaattttggtacgatcatgcgaattcaaattctacaactacaggcattatggctggaaattctagtggggggattaggcatgagattgacgtgaaggaccggcccatacaggagttgcgcatggagttttctcacgacgtactcgcttcattgcaacttcatttccaagatggtacagcaacgcagaaatttggcaatgtaaatggttgggcatctagaatagccacttgcacagccccctacagctacaagcttagctcatgggcctttcgtgaagatcccggccccaacgggacgacagccatcagtgtacttcgctttgattttacacctgaagatccctcatca

SEQ ID NO: 132 - DNA, 1467 bp, Polypodium formosanum
atggattcggatttgattgctcagcctcatgacgataacgccgcttctgtgggtgccccggctgcagagaaggttgaggaggaagagtcggtagtgacaatgccagaaacggatcaggactcagacgttgatccgcaattcgaacaagaaatgaacaatatttctgcgcttatcgctgctggtgcagtggaggggcacgacgacgtagatcttttcgccaaatacatgcaggtcgaggctcacgactggcataatcgacttagacaagctatactgggcctaacgcttgcaataccaaacccaattgtgggtttagcgataagcgggtttatccggctcatttggccagcaaacaaggtgagtatttgggaggctctgaatgcggagcaatacattaggaacattgtccagcaggagctgatgcagttcgaaatgcggacacttcagtcccaaatcgagacgctgcaaaccacaattcacagatacgatcaggccgctgcaattcctgagaaggggaactttctaagcaactggatctcgcaagctgatggtttgttctctagcatgcgcaactcttccaacagaatccatcttctccttcacattgtcaccgtggctacgctgcatatggcagctctgcatgagcgactgagttttggcaaggaactctacggcgtagacgatacagcaagttggaagcgagctctggagcaaatgtttgaggagtacacgatcaaattaatcccgacaatcttcaaggagtggaggccgtggcgggaaacccagattgagattaacgaatggagacagaggggtcaatcgggcgtaagtatatttcgtccagactcttcgcatgctaccgtgcaggataagctttcaggggaacttttcacatttcgggtgaattatcaatactcgacaacaattttttctggagtgaccagagatcataggactcggatgataaatgaggcaattgcggacatggctagctgcatatcacccacttttgctctccacacgctcctacctgatgatgtcaagacaaagtattctccttacgacaaggcgatattcggtcgggtgattataagagcgcagcaccacgttgatgctatacagtttttgtacgatcatgcaaatccaaatcttacaactaatggcctcatggctggaaattctagcggggggattaggtatcagattaacgtgagggaccggcccatagaagagttgcgcatggagttttctcgcgacgtgctcgcttcattgcaacttcatttccaagatggtacagcaacgcagaaatttggcaatgtaaatagttgggcaactacaatagccacttgcacggccccctttggctacaagcttagctcatgggcctttcgtgaagatcctggccccaatgggacgttagccatcagtgtacttcggttcgatttcacacctgaagatccctcaaca

SEQ ID NO: 133 - DNA, 1581 bp, Polypodium formosanum
atggattcggatttgattgctcagcctcatgacgataacgccgcttctgtgggtgccccggctgcagagaaggttgaggaggaagagtcggtagtgacaatgccagaaacggatcaggactcagacgttgatccgcaattcgaacaagaaatgaacaatatttctgcgcttatcgctgctggtgcagtggaggggcacgacgacgtagatcttttcgccaaatacatgcaggtcgaggctcacgactggcataatcgacttagacaagctatactgggcctaacgcttgcaataccaaacccaattgtgggtttagcgataagcgggtttatccggctcatttggccagcaaacaaggtgagtatttgggaggctctgaatgcggagcaatacattaggaacattgtccagcaggagctgatgcagttcgaaatgcggacacttcagtcccaaatcgagacgctgcaaaccacaattcacagatacgatcaggccgctgcaattcctgagaaggggaactttctaagcaactggatctcgcaagctgatggtttgttctctagcatgcgcaactcttccaacagaatccatcttctccttcacattgtcaccgtggctacgctgcatatggcagctctgcatgagcgactgagttttggcaaggaactctacggcgtagacgatacagcaagttggaagcgagctctggagcaaatgtttgaggagtacacgatcaaattaatcccgacaatcttcaaggagtggaggccgtggcgggaaacccagattgagattaacgaatggagacagaggggtcaatcgggcgtaagtatatttcgtccagactcttcgcatgctaccgtgcaggataagctttcaggggaacttttcacatttcgggtgaattatcaatactcgacaacaattttttctggagtgaccagagatcataggactcggatgataaatgaggcaattgcggacatggctagctgcatatcacccacttttgctctccacacgctcctacctgatgatgtcaagacaaagtattctccttacgacaaggcgatattcggtcgggtgagcagaggcccatattctcaagatcttcgtcaacaacttttcacgattgtcaaagatttcagatcgcatccaagacgctttgatcagaccgctcgtgatagagtcttggaggtgattataagagcgcagcaccacgttgatgctatacagtttttgtacgatcatgcaaatccaaatcttacaactaatggcctcatggctggaaattctagcggggggattaggtatcagattaacgtgagggaccggcccatagaagagttgcgcatggagttttctcgcgacgtgctcgcttcattgcaacttcatttccaagatggtacagcaacgcagaaatttggcaatgtaaatagttgggcaactacaatagccacttgcacggccccctttggctacaagcttagctcatgggcctttcgtgaagatcctggccccaatgggacgttagccattagcgtacttcggttcgatttcacacctgaagatccctcaaca

SEQ ID NO: 134 - DNA, 1581 bp, Polypodium formosanum
atggattcggatttgattgctcagcctcatgacgataacgccgcttctgtgggtgccccggctgcagagaaggttgaggaggaagagtcggtagtgacaatgccagaaacggatcaggactcagacgttgatccgcaattcgaacaagaaatgaagaatatttctgcgcttatcgctgctggtgcagtggaggggcacgacgacgtagatcttttcgccaaatacatgcaggtcgaggctcacgactggcataatcgacttagacaagctatactgggcctaacgcttgcaataccaaacccaattgtgggtttagcgataagcgggtttatccggctcatttggccagcaaacaaggtgagtatttgggaggctctgaatgcggagcaatacattaggaacattgtccagcaggagctgatgcagttcgaaatgcggacacttcagtcccaaatcgagacgctgcaaaccacaattcacagatacgatcaggccgctgcaattcctgagaaggggaactttctaagcaactggatctcgcaagctgatggtttgttctctagcatgcgcaactcttccaacagaatccatcttctccttcacattgtcaccgtggctacgctgcatatggcagctctgcatgagcgactgagttttggcaaggaactctacggcgtagacgatacagcaagttggaagcgagctctggagcaaatgtttgaggagtacacgatcaaattaatcccgacaatcttcaaggagtggaggccgtggcgggaaacccagattgagattaacgaatggagacagaggggtcaatcgggcgtaagtatatttcgtccagactcttcgcatgctaccgtgcaggataagctttcaggggaacttttcacatttcgggtgaattatcaatactcgacaacaattttttctggagtgaccagagatcataggactcggatgataaatgaggcaattgcggacatggctagctgcatatcacccacttttgctctccacacgctcctacctgatgatgtcaagacaaagtattctccttacgacaaggcgatattcggtcgggtgagcagaggcccatattctcaagatcttcgtcaacaacttttcacgattgtcaaagatttcagatcgcatccaagacgctttgatcagaccgctcgtgatagagtcttggaggtgattataagagcgcagcaccacgttgatgctatacagtttttgtacgatcatgcaaatccaaatcttacaactaatggcctcatggctggaaattctagcggggggattaggtatcagattaacgtgagggaccggcccatagaagagttgcgcatggagttttctcgcgacgtgctcgcttcattgcaacttcatttccaagatggtacagcaacgcagaaatttggcaatgtaaatagttgggcaactacaatagccacttgcacggccccctttggctacaagcttagctcatgggcctttcgtgaagatcctggccccaatgggacgttagccattagcgtacttcggttcgatttcacacctgaagatccctcaaca

SEQ ID NO: 135 - DNA, 1563 bp, Nephrolepis obliterata
atggcaggatataatcacgtgcaggatcaattagtaatgcaggcagctgaggatgttaatactgtttctgagctagctcccgctgctgatcagaaggagcagaacgccacaggcatggccgaagaggacccaatttttgcgcaattagcgcagaaaatggctgctgctgcagagaaggaggaggcccccgtagatcttcttgcccaatacatgcaagtggaggctcatgactggcataaccggatcagaggcgccatattggggctgatatccgcagtgccgaaggtgggtgctgctataagcaggctcatcggcctcttttggccatccaacaaggtggacatttgggaggccctcaacgcggaggagtatatcaggaacattgtccagcaggagctttttgaattcgaaatgcagcttcttcagaacgacatccaagcgctggaagccactgttgggagatacgatacggctgcacttactgaaaagggcaactttctaagcatctggatctcgcaagctgatgcgttgtatattcggatgcgaaactctaccaacaacatccacctcctccttcacatggtcaccgtgtctacacttcatctcgcagccctacacgagcgcctcacatttggcgaggaactgtatggcacaaacaattcagcgaattggacacaagatcttgtggataagttcgagaggtacacaaccgatttaatcccgactgttttcagaaggtggaaggaatggaggccaacccagatcgagattacaacatgggtacgcaggggctcatgcggcaatcttatttgtagaccagacgtttctcatgctacagtggaggacaagatctccggggcattattctcattccaggcaacaaatcgaaactcgacaacaattttctcagaagtttgcgaagaccacaaaactcgaatggtgaacgaggccattgcggacatggcgagctgcctgtcacccacttttgctttccacaagctcctacccgacgatattcagacgcagttctctccttacgatcggcagcaattcggacaggttttcagaggcccatattcccaggatctttcgcacggactctggacggttttcaaatccttcagatcgcgcacaacacgctctgatcagacacttcgcgatagaatcttggaggtgatcataagagcggggcaccatgttgatgctatacagttcgtgtacgatcatgtgaatccaaattctacgactccggggattgtggctggaaatgccgcgggaggaactaggcatcagattgatgtgagggatcggcccataaaggaagtgcgcatggagttctctcaggatgtgcttgcttcgttgcagctccattttgaggatggcacatcaacacggaaattcggcaatgaacttggttgggcgactagaatactaacttgtacagtgccctatggctacaggttcagctcatgggcctttcgtgaagatcccggcccctacagaacaaccgccatcagtgtactccgcttccaattcacccctgagctggatatgcccttgcca

SEQ ID NO: 136 - DNA, 1536 bp, Colysis wrightii
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggaggaatatatcaggaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcctgtcacccacttttgctttccacaagctcctacccgacgatattcagacgcagttctctccttacgatcggcagcagttcggacaggttttcagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcaagatgtgcttgcttcgttgcagctccattttgaggatggtacatcaacacggaaattcggcaatgaacttggttgggcgactagaatactgacttgtacagcgccctatggctacaggttcagctcatgggcctttcgtgaagatcccggcccctacagaacaaccgccatcagtgtactccgcttccaattcacccccgagctggatatgcccttgccagcatcttatatgctctca

SEQ ID NO: 137 - DNA, 1530 bp, Nephrolepis exaltata
atggcagcagctgaggatgttaatactgtttctgagctagctcccgctgctgatcagaaggagcagaacgacgccacaggcatggccgaagaggacccaatttttgcgcaattagcgcagaaaatggctgctgctgcagagaaggaggaggcccccgtagatcttcttgcgcaatacatgcaagtggaggctcatgactggcataaccggatcagaggcgccatattggggctgatatccgcagtgccgaaggtgggtgctgctataagcaggctcatcggcctcttttggccatcaaacaaggtggacatttgggaggccctcaacgcggaggagtatatcaggaacattgtccagcaggagcttttcgaattcgaaatgcagcttcttcagaacgacatccaagcgctggaaaccacggttgggagatacgatacggctgcacttactgaaaagggcaactttctaagcatctggatctcgcaagctgatgcgttgtatattcggatgcgaaactctaccaacaacatccaccttctccttcacatggtcaccgtgtctacacttcatctcgcagccctacatgagcgactcacatttggcgaggaactgtatggcacaaacaatgcagcgaattggacacaagatcttgtggataagttcgagaggtacacaaccgatttaatcccgaatgttttcagaaggtggaaggaatggaggccaacccagatcgagattacaacatgggtacgcaggggctcatgcggcaatcttacttgtagaccagacgtttcttatgctacagtggaggacaagatctccggggcattattctcattccaggcaacaaatcgaaactcgacaacaattttctcagaagtttgcgaagaccacaaaactcgaatggtgaacgaggccattgcggacatggcgagctgcctgtcacccacttttgctttccacaagctcctacccgacgatattcagacgcagttctctccttacgatcggcagcaatttggacaggttttcagaggcccatattcccaggatctttcgcacggactctggacggttttcaaatccttcagatcgcgcacaacacgctctgatcagacacttcgcgatagaatcttggaggtgatcataagagcggggcaccatgttgatgctatacagttcgtgtacgatcatgtgaatccaaattctacgactccggggattgtggctggaaatgccgcgggaggaactaggcatcagattgatgtgagggatcggcccataaaggaagtgcgcatggagttctctcaggatgtgcttgcttcgttgcagctccattttgaggatggcacatcaacacggaaattcggcaatgaacttggttgggcgactagaatactaacttgtacagtgccctatggctacaggttcagctcatgggcctttcgtgaagatcccggcccctacagaacaaccgccatcagtgtactccgcttccaattcacccctgagctggatatgcccttgcca

SEQ ID NO: 138 - DNA, 1569 bp, Davallia tyermannii
atggcaggatataatcacgtgcaggatcaactagtaatgccagctgaggacgttaatacgcccgttaatactgtttctgagcttgctcccgctgctgagaaggtgcagaacgcagacatggcggccgaagaggacccaatttttacgcaactagcgcagaagatggctgctgctgcagagaaggaggaggcccccgtagatcttcttgcccaatacatgcaagtggaggctcatgactggcataaccggatcagaggcgccatactggggctgatatccgcagtgccgaaggtgggtgctgctataagcaggctcatcggcctcttttggccatcaaacaaggtggacatttgggaggccctcaacttggagggatatatcaggaacattgtccagcaggagctttttgaattcgaattgcagctccttcagaacgacatccaagcgctggaggccactgttgggagatacgatagagctgcacttactgaaaaggggaactttctaagcatctggatctcgcaagctgatgcattgtatattcggatgcgaaactctagcaacaacatccaccttctccttcacatggtcaccgtgtctacacttcatctcgcagccctgcacgagcgactgacatttggcgaggaattgtatggctcaaacaattcagcgaactggacgcacgatcttgtggacaagttcgagaggtacacaacggatttaatcccgaacgttttcaaaaggtggaaggaatggaggccaacccagatcgtgattacaacatgggtacgcaggggctcatgcggcaatcttatctgtcgcccagacatttcttatgctacagtggaggacaagttgtccggggcattattctcatttcaggcaacaaatcgaaactcgacaacaattttcttagaagtttgcgaagaccacaaaactcggatgatgaacgaggccgttgcggacatggcgagctgcctgtcacccacttttgctttccacaagctcctacccaacgatattcagacacagttctctccttacgatcggcagcagttcggacaggttttcagaggcccatattccgcggatctttcgcacggactctggacggttttcaagtccttcagatcgcgcacaacacgctctgatcagacacttcgcgatagaatcttggaggtgatcataagagcggggcaccatgttgatgctatacagttcgtgtacgatcatgtgaatccaaattctacgactccggggattgtggctggaaacgccgccggaggaactaggcatcaggttgatgtgagggatcggcccatacaagaattgcgcatggagttctctcaggatgtgcttgcttcgttgcagctccatttcgaggatggtacatcaacacggaaattcggcaacgaacttggttgggcaactagaatactaacttgtacagcgccctatggctacagattaagctcatgggcctttcgtgaagatcccggcccctatagaacaaccgccatcagtgtactccgcttccaattcacccccgagctggatatgcccttgcca

SEQ ID NO: 139 - DNA, 1578 bp, Pyrrosia lanceolata
atggcaggatataatcacgtgcaggatcaattagtaatggcagctgatcaggacgttaatactgtttctgagcttgctcccgctactgataaggtgcagaacgaagacatggtcgaagaggacccaatttttgcgcaattagcggagaagatggctgctgctgcagagaaaggggaggcccctgtagatcttcttgctcaatacatgcaagtggaggctcatgactggcataaccggatcagaggcgccatactggggctgatatccttagtgccaaaggtgggtgctgctgtaagcaggctcatcggcctcttttggccagcaaacaaggtggacatttgggaggccctcaaggcggaggaatatatcaggaacattgtccagcaggagctttttgagttcgaaatgcggctccttcaggacgacatcgaagcgctggaaatgactgttgcgagatacgatagggctgcacttactgaaaaggggaactttctaagcatctggatctcgcaagctgatgcattgtatattcggatgcggaactctaccaacaacatccaccttctccttcacatggtcactgtgtctacacttcatatggcagccctgcatgagcgactgacatttggcgaggaactgtatggcacaaacaattcagcgaattggacgcaagatcttgtggacaagttcgagaggtacacagccgatttaatcccgagtgttttcaaaaggtggaaggaatggaggccaacccagatcgagattagagcatggataaataggggctcatgcggcaatcttacttgtagaccaaacgtttctcatgctacagtggaggacaagacctccggggcaagattctcatttcagtcaagcggtagttcctcgacaacaatgttctcagaaatttgcgaagaccacaaaactcggatggtgaacgaggccatcgcggacatggcgagctgcctgtcacccacttttgctttccacaagctcctacccgacgatattcaggcgcagttctctccttacgatcggcaggagttcggacaggttttcagaggcccgtattcccaggatctttcgcacggagcttggacaaatttcaaaaacttcagatcgcgcacaacacgctctgatcagacacttcgcgatagaatcttggaggtgatcataagagcgggatctcatgttgatgctttacagttcatctacgatcatgtgaatccaaattctatgactccggggattatggctggaaatgccgcgggaggagttaggcatcaggttgatgtgagggatcggcccatacaggaagtgcgcatggagttcgctcgggatgtgcttgcttcgctgcagctccatttcgaggatggtacatcaacacagaaattcggcaatgaactttttggtacttgggcgactagaatactaacttgtacagcgccctatggctacagattcagctcatgggcctttcgtgaagatcccggcccctacagaacaaccgccatcagtgtactccgcttccaattcacccccgagctggatatgcccctcccctcagagtatctcata

SEQ ID NO: 140 - DNA, 1578 bp, Pyrrosia lanceolata
atggcaggatataatcacgtgcaggatcaattagtaatggcagctgatcaggacgttaatactgtttctgagcttgctcccgctactgataaggtgcagaacgaagacatggtcgaagaggacccaatttttgcgcaattagcggagaagatggctgctgctgcagagaaaggggaggcccctgtagatcttcttgctcaatacatgcaagtggaggctcatgactggcataaccggatcagaggcgccatactggggctgatatccttagtgccaaaggtgggtgctgctgtaagcaggctcatcggcctcttttggccagcaaacaaggtggacatttgggaggccctcaaggcggaggaatatatcaggaacattgtccagcaggagctttttgagttcgaaatgcggctccttcaggacgacatcgaagcgctggaaatgactgttgcgagatacgatagggctgcacttactgaaaaggggaactttctaagcatctggatctcgcaagctgatgcattgtatattcggatgcggaactctaccaacaacatccaccttctccttcacatggtcactgtgtctacacttcatatggcagccctgcatgagcgactgacatttggcgaggaactgtatggcacaaacaattcagcgaattggacgcaagatcttgtggacaagttcgagaggtacacagccgatttaatcccgagtgttttcaaaaggtggaaggaatggaggccaacccagatcgagattagagcatggataaataggggctcatgcggcaatcttacttgtagaccaaacgtttctcatgctacagtggaggacaagacctccggggcaagattctcatttcagtcaagcggtagttcctcgacaacaatgttctcagaaatttgcgaagaccacaaaattcggatggtgaacgaggccatcgcggacatggcgagctgcctgtcacccacttttgctttccacaagctcctacccgacgatattcaggcgcagttctctccttacgatcggcaggagttcggacaggttttcagaggcccgtattcccaggatctttcgcacggagcttggacaaatttcaaaaacttcagatcgcgcacaacacgctctgatcagacacttcgcgatagaatcttggaggtgatcataagagcgggatctcatgttgatgctttacagttcatctacgatcatgtgaatccaaattctatgactccggggattatggctggaaatgccgcgggaggagttaggcatcaggttgatgtgagggatcggcccatacaggaagtgcgcatggagttcgctcgggatgtgcttgcttcgctgcagctccatttcgaggatggtacatcaacacagaaattcggcaatgaactttttggtacttgggcgactagaatactaacttgtacagcgccctatggctacagattcagctcatgggcctttcgtgaagatcccggcccctacagaacaaccgccatcagtgtactccgcttccaattcacccccgagctggatatgcccctcccctcagagtatctcata

SEQ ID NO: 141 - DNA, 1569 bp, Pyrrosia lanceolata
atggcaggatataatcacgtgcaggatcaattagtaatggcagctgatcaggacgttaatactgtttctgagcttgctcccgctactgataaggaagacatggtcgaagaggacccaatttttgcgcaattagcggagaagatggctgctgctgcagagaaaggggaggcccctgtagatcttcttgctcaatacatgcaagtggaggctcatgactggcataaccggatcagaggcgccatactggggctgatatccttagtgccaaaggtgggtgctgctgtaagcaggctcatcggcctcttttggccagcaaacaaggtggacatttgggaggccctcaaggcggaggaatatatcaggaacattgtccagcaggagctttttgagttcgaaatgcggctccttcaggacgacatcgaagcgctggaaatgactgttgcgagatacgatagggctgcacttactgaaaaggggaactttctaagcatctggatctcgcaagctgatgcattgtatattcggatgcggaactctaccaacaacatccaccttctccttcacatggtcactgtgtctacacttcatatggcagccctgcatgagcgactgacatttggcgaggaactgtatggcacaaacaattcagcgaattggacgcaagatcttgtggacaagttcgagaggtacacagccgatttaatcccgagtgttttcaaaaggtggaaggaatggaggccaacccagatcgagattagagcatggataaataggggctcatgcggcaatcttacttgtagaccaaacgtttctcatgctacagtggaggacaagacctccggggcaagattctcatttcagtcaagcggtagttcctcgacaacaatgttctcagaaatttgcgaagaccacaaaactcggatggtgaacgaggccatcgcggacatggcgagctgcctgtcacccacttttgctttccacaagctcctacccgacgatattcaggcgcagttctctccttacgatcggcaggagttcggacaggttttcagaggcccgtattcccaggatctttcgcacggagcttggacaaatttcaaaaacttcagatcgcgcacaacacgctctgatcagacacttcgcgatagaatcttggaggtgatcataagagcggggtctcatgttgatgctttacagttcatgtacgatcatgtgaatccaaattctacgactccgggggttatggctggaaatgccgcgggaggagtgaggcatcaggttgatgtgagggatcggcccatacaggaagtgcgcatggagttcgctcgggatgtgcttgcttcgttgcagctccatttcgaggatggtacatcaactcagaaattcggcaatgaactttttggtacttgggcgactagaatactaacttgtacagcgccctatggctacagattcagctcatgggcctttcgtgaagatcccggcccctacagaacaaccgccatcagtgtactccgcttccaattcacccccgagctggatatgcccctcccctcagagtatctcata

SEQ ID NO: 142 - DNA, 1527 bp, Tectaria milnei
atggcagctaaggacgttaatactgtttctgagctagctcccgctgctgatcagaaggagcagaacgacgccacaggcatggccgaagaggacccaatttttgcgcaattagcgcagaaaatggctgctgctgcagagaaggaggaggcccccgtagatcttcttgcgcaatacatgcaagtggaggctcatgactggcataaccggatcagaggcgccatattggggctgatatccgcagtgccgaaggtgggtgctgctataagcaggctcatcggcctcttttggccatcaaacaaggtggacatttgggaggccctcaacgcggaggagtatatcaggaacattgtccagcaggagcttttcgaattcgaaatgcagcttcttcagaacgacatccaagcgctggaaaccacggttgggagatacgatacggctgcacttactgaaaagggcaactttctaagcatctggatctcgcaagctgatgcgttgtatattcggatgcgaaactctaccaacaacatccaccttctccttcacatggtcaccgtgtctacacttcatctcgcagccctacatgagcgactcacatttggcgaggaactgtatggcacaaacaatgcagcgaattggacacaagatcttgtggataagttcgagaggtacacaaccgatttaatcccgaatgttttcagaaggtggaaggaatggaggccaacccagatcgagattacaacatgggtacgcaggggctcatgcggcaatcttacttgtagaccagacgtttcttatgctacagtggaggacaagatctccggggcattattctcattccaggcaacaaatcgaaactcgacaacaattttctcagaagtttgcgaagaccacaaaactcgaatggtgaacgaggccattgcggacatggcgagctgcctgtcacccacttttgctttccacaagctcctacccgacgatattcagacgcagttctctccttacgatcggcagcaatttggacaggttttcagaggcccatattcccaggatctttcgcacggactctggacggttttcaaatccttcagatcgcgcacaacacgctctgatcagacacttcgcgatagaatcttggaggtgatcataagagcggggcaccatgttgatgctatacagttcgtgtacgatcatgtgaatccaaattctacgactccggggattgtggctggaaatgccgcgggaggaactaggcatcagattgatgtgagggatcggcccataaaggaagtgcgcatggagttctctcaggatgtgcttgcttcgttgcagctccattttgaggatggcacatcaacacggaaattcggcaatgaacttggttgggcgactagaatactaacttgtacagtgccctatggctacaggttcagctcatgggcctttcgtgaagatcccggcccctacagaacaaccgccatcagtgtactccgcttccaattcacccctgagctggattttcccttgtct

SEQ ID NO: 143 - DNA, 1539 bp, Polystichum proliferum
atggcagctgaggacgttaatactgtttctgagcttgctcccgctgctgacgaggtgcagaacgcagacatggccgtcgaggaggacccaatcttctcgcaattagcgcagaagatggtggctgctgctgctgctgcggagggggaggaggtccccgtggatcttcttgcccaatacatgcaagtggaggctcatgactggcataaccgaatcagaggcgccgtactggggctgatatccgcagtgccgaaggtgggtgctgccataagcaggctcatcggcctcttttggccatcaaacaaggtggacatttgggaggccctgaatgcggaggaatatatcaggaacattgtccagcaggagctttttcaattcgaaatgcagctccttcggaacgacatcgaagcgctggaaaccacggttgggagatacgatacggcggctcttactgagaaggggaatttcctaagcatctggatcacgcaagctgatgcactgtatattcggatgcgaaactctaccaacaacatccaccttctccttcacatggtcaccgtgtctacactacatctcgcagccctgcatgagcgactcacatttggcgaggaactctatggcacaaacaattcagcgaattggactcaagatcttgtggataagttcgagctgtacacaaccgatttgatcccgagtgtttttaaaaggtggaaggactggaggccaacccaaatcgagattacagcttgggtacaaaggggctcatgcggcaatcttacctgtagaccgaacgtttcttatgctagagtggaggataagatctccggggcaatattctcgtttcaggcaacgaatcgaaattcaacaacaattttctcaggaatttgtgaagatcacaaaactcggatggtgaacgaggccattgctgacatggccagctgcctgtcacccacttttgcttttcacaagctcctaccagaccacattcagccgcggttctctgcttttgatagggagcagttcggacaggttttcagaggcccatattcccacgatctttcgcacggagcctggacggctctcaaatccttcagatcgcacacaactcgctctgatcagacaaatcgcgatagaatcttggaggtgatcataagagcgggtagccatgttgatgctatacagtttatgtacgatcatgcgaatccaaatgctatgactgcagggattatggctggaaactccgcgggagggcagaggtattgggtcgatgtgaggggtcggcccattcaggaactgcgcatggcgttcgctcgtgacgtgcttgcttcgttgcaacttcattttgaggatggtacatcaacacccagatttggcgatgacgttggttgggcgtctagaatactaacttgtacagccccctatggctacaggttcagctcatgggcctttcgtgaagatcccggcccctacggatcaactgccatcagtgtactccgcttccaattcactcccgagctggatattcccttgccagcgcatata

SEQ ID NO: 144 - DNA, 1539 bp, Polystichum proliferum
atggcagctgaggacgttaatactgtttctgagcttgctcccgctgctgacgaggtgcagaacgcagacatggccgtcgaggaggacccaatcttctcgcaattagcgcagaagatggtggctgctgctgctgctgcggagggggaggaggtccccgtggatcttcttgcccaatacatgcaagtggaggctcatgactggcataaccgaatcagaggcgccgtactggggctgatatccgcagtgccgaaggtgggtgctgccataagcaggctcatcggcctcttttggccatcaaacaaggtggacatttgggaggccctgaatgcggaggaatatatcaggaacattgtccagcaggagctttttcaattcgaaatgcagctccttcggaacgacatcgaagcgctggaaaccacggttgggagatacgatacggcggctcttactgagaaggggaatttcctaagcatctggatcacgcaagctgatgcactgtatattcggatgcgaaactctaccaacaacatccaccttctccttcacatggtcaccgtgtctacactacatctcgcagccctgcatgagcgactcacatttggcgaggaactctatggcacaaacaattcagcgaattggactcaagatcttgtggataagttcgagctgtacacaaccgatttgatcccgagtgtttttaaaaggtggaaggactggaggccaacccaaatcgagattacagcttgggtacaaaggggctcatgcggcaatcttacctgtagaccgaacgtttcttatgctagagtggaggataagatctccggggcaatattctcgtttcaggcaacgaatcgaaattcaacaacaattttctcaggaatttgtgaagatcacaaaactcggatggtgaacgaggccattgctgacatggccagctgcctgtcacccacttttgcttttcacaagctcctacccgaccacattcagccgcggttctctgcttttgatagggagcagttcggacaggttttcagaggcccatattcccaggatctttcgcacggagcctggacggctctcaaatccttcagatcgcacacaactcgctctgatcagacaaatcgcgatagaatcttggaggtgatcataagagcggggagccatgttgatgctatacagtttatgtacgatcatgcgaatccaaatgctatgactgcagggattatggctggaaactccgcgggagggcataggtattgggtcgatgtgaggggtcggcccattcaggaactgcgcatggcgttcgctcgtgacgtgcttgcttcgttgcaacttcattttgaggatggtacatcaacacccagatttggcgatgacgttggttgggcgtctagaatactaacttgtacagcgccctatggctacaggttcagctcatgggcctttcgtgaagatcccggcccctacggatcaactgccatcagtgtactccgcttccaattcactcccgagctggatattcccttgccagcgcatata

SEQ ID NO: 145 - DNA, 1539 bp, Polystichum proliferum
atggcagctgaggacgttaatactgtttctgagcttgctcccgctgctgacgaggtgcagaacgcagacatggccgtcgaggaggacccaatcttctcgcaattagcgcagaagatggtggctgctgctgctgctgcggagggggaggaggtccccgtggatcttcttgcccaatacatgcaagtggaggctcatgactggcataaccgaatcagaggcgccgtactggggctgatatccgcagtgccgaaggtgggtgctgccataagcaggctcatcggcctcttttggccatcaaacaaggtggacatttgggaggccctgaatgcggaggaatatatcaggaacattgtccagcaggagctttttcaattcgaaatgcagctccttcggaacgacatcgaagcgctggaaaccacggttgggagatacgatacggcggctcttactgagaaggggaatttcctaagcatctggatcacgcaagctgatgcactgtatattcggatgcgaaactctaccaacaacatccaccttctccttcacatggtcaccgtgtctacactacatctcgcagccctgcatgagcgactcacatttggcgaggaactctatggcacaaacaattcagcgaattggacgcaagatcttgtggataagttcgagctgtacacaaccgatttgatcccgagtgtttttaaaaggtggaaggactggaggccaacccaaatcgagattacagcttgggtacaaaggggctcatgcggcaatcttacctgtagaccgaacgtttcttatgctagagtggaggataagatctccggggcaatattctcgtttcaggcaacgaatcgaaattcaacaacaattttctcaggaatttgtgaagatcacaaaactcggatggtgaacgaggccattgctgacatggccagctgcctgtcacccacttttgcttttcacaagctcctaccagaccacattcagccgcggttctctgcttttgatagggagcagttcggacaggttttcagaggcccatattcccacgatctttcgcacggagcctggacggctctcaaatccttcagatcgcacacaactcgctctgatcagacaaatcgcgatagaatcttggaggtgatcataagagcggggagccatgttgatgctatacagtttatgtacgatcatgcgaatccaaatgctatgactgcagggattatggctggaaactccgcgggagggcataggtattgggtcgatgtgaggggtcggcccattcaggaactgcgcatggcgttcgctcgtgacgtgcttgcttcgttgcaacttcattttgaggatggtacatcaacacccagatttggcgatgacgttggttgggcgtctagaatactaacttgtacagccccctatggctacaggttcagctcatgggcctttcgtgaagatcccggcccctacggatcaactgccatcagtgtactccgcttccaattcactcccgagctggatattcccttgccagcgcatata

SEQ ID NO: 146 - DNA, 1530 bp, Polystichum acrostichoides
atggcagctgagcacgacgttaattctgtggttgctgcgcctgctgaggaggtgcagaaagacgcagactgcatggaggaggaggacccagttttttcgcaattagcgcaaaagatggttgctgctgctgctgcggaggggctgcaggagaaccccgttgatctgcttgccaaatacatgcaagtggaggctcatgactggcataaccggattagaggcgctgtactggggctgttatccgcagtgccgaaggtgggtgctgccataagcatgctcatcggcctcttttggccagcaaacagggtggacatttgggaggccatcaatgcggaggaatatattaggaacattgtccagcaggagatttttgaattcgagctgcagctacttcggagcgacatcgaagcgctggaaaccactattggacactacgatacggctgcgcttactgagaggggtggttttctaagcatctggatcacacaagctagcgcattgcatattcggatgcgaaactctgcccagaacatccaccttctgcttcacattgtcaccgtgtctacgcttcatatcgcagccctgcatgagcggctgatatttggccaggaactctacggctcaagcaatacagcaggctggacgcgagatcttgtgaatgcgttcgagatgtacacaaccgatttaatcccaaatgtcttcaaaaggtggaaggagtggagggagaaccagattgagattagagcatgggtagtcaggggctcatgcggaaatcttatttgtaggccaaacatttctcatgctacagtggaggataaggtctcaggggagagattctcgtttcaggcaacgaatcgaaactcaacaacaattttctcaggaatttgcgaagatcacaaaattcggatggggaacgaggcgattgcggacatggccagctgtttgtcacccacttttgctttccacaagctcctacccgacgatattcagacacagttctctccttatgatagggagcagttcgggcgggttttcagaggcccatattcccaggatctttcgcacggacactggacggctgtcaaatccttcagatcgcatccaacacgctttgatcagacggctcgcgacagaatcttgcaggtgatcataagagcggggtcccatgttgatgctatacaattttggtacgatcatgtgaattcaaatgctatgactgcagggactatggccggaaaccccctggggggcaataggcatgaggttgatgtgaggaatcggcccatacaggaattgcgcatggagttcgctcgtgacgtgcttgcttcgttgcaacttcgtttcgaagatggtacatcaacaccggaatttggcaatgatggttgggccactagaatattaacttgtacagccccctatggctacaggctcagctcatgggcctttcgtgaagatcccggtccctaccaaacaaccgccatcagtgtactccgcttccaattcacccccgaggacattatcatccccccaaat

SEQ ID NO: 147 - DNA, 1581 bp, Pyrrosia rupestris
atggcaggatataatcacgtgcaggatcaattagtaatggcagctgatcaggacgttaatactgtttctgagcttgctcccgctactgataaggtgcagaacggtgacatggtcgaagaggacccaatttttgcgcaattagcgcagaagatggctgctgctgcagagaagggggaggcccccgtagatcttcttgcccaatacatgcaagtggaggctcatgactggcataaccggatcagaggagccatactggggctgatatccgcagtgccgaaggtgggcgctgctataagcaggctcatcggcctcttttggccagcaaatagggtggacatttgggaggctctaagggcggaggaatatatcaggaacattgtccagcaggagctttttgaatttgaaatgcggcttcttcagaacgacatcgaagcgctggaaatgacggttgggagatacgatacggctgcacttactgaaaaggggaactttctaagcatctggatctcgcaagctgatgcattgtatattcggatgcggaactctaccaacaacatccaccttctccttcacatggtcactgtgtctacacttcatatggcagccctgcatgagcgactgacatttggcgaggaactgtatggctcaaacaattcagcgaattggacggcagatcttgtggacaagttcgagaggtacacaaccgatttaatcccgagtgttttcaaaaggtggaaggaatggaggccaacccagatcgagattagagcatggatacacaggggctcatgcggcaatcttacctgtagaccaaacgtttctcatgctacagtggaggataagatctccggggcattattctcatttcagtcaaccggtagttcctcgacaacaatgttctcagaagtttgcgaagaccacaaaactcggatggtgaacgaggccattgcggacatggcgagctgcctgtcacccacttttgcttttcacaagctcctacccgacgacattcaggcgcaattctctccttatgatcggcaggagttcggacaggttttcagaggcccatattcccaggatctttcgcacggactctggacgagtttcaaaaacttcagatcgcgcacaacacgctctgatcagacacttcgcgatagaatcttggaggtgatcataagagcggggtcccatgttgatgctatacaattcgtgtacgatcatgcgaatccaaattctacgactctggggactctggctggaaacgccacgggaggaaataggcatcaggttgatgtgagggatccgcccatacaggaattgcgcatggagttcgctcgggatgtgcttgcttcgttgcagcttcattttgaggatggtacatcaacacagaaattcggcaatgtactttttggtacttgggcgactagaatactaacttgtacagcgccctatggctacagattcagctcatgggcctttcgtgaagatcccggcccctatggaacaaccgccatcagtgtactccgcttccaattcacccccgagctggatatgcccttgccagcatcttatatgatctta

SEQ ID NO: 148 - DNA, 1572 bp, Pyrrosia rupestris
atggcaggatataatcacgtgcaggatcaattagtaatggcagctgatcaggacgttaatactgtttctgagcttgctcccgctactgataagggtgacatggtcgaagaggacccaatttttgcgcaattagcgcagaagatggctgctgctgcagagaagggggaggcccccgtagatcttcttgcccaatacatgcaagtggaggctcatgactggcataaccggatcagaggagccatactggggctgatatccgcagtgccgaaggtgggcgctgctataagcaggctcatcggcctcttttggccagcaaatagggtggacatttgggaggctctaagggcggaggaatatatcaggaacattgtccagcaggagctttttgaatttgaaatgcggcttcttcagaacgacatcgaagcgctggaaatgacggttgggagatacgatacggctgcacttactgaaaaggggaactttctaagcatctggatctcgcaagctgatgcattgtatattcggatgcggaactctaccaacaacatccaccttctccttcacatggtcactgtgtctacacttcatatggcagccctgcatgagcgactgacatttggcgaggaactgtatggctcaaacaattcagcgaattggacggcagatcttgtggacaagttcgagaggtacacaaccgatttaatcccgagtgttttcaaaaggtggaaggaatggaggccaacccagatcgagattagagcatggatacacaggggctcatgcggcaatcttacctgtagaccaaacgtttctcatgctacagtggaggataagatctccggggcattattctcatttcagtcaaccggtagttcctcgacaacaatgttctcagaagtttgcgaagaccacaaaactcggatggtgaacgaggccattgcggacatggcgagctgcctgtcacccacttttgcttttcacaagctcctacccgacgacattcaggcgcaattctctccttatgatcggcaggagttcggacaggttttcagaggcccatattcccaggatctttcgcacggactctggacgagtttcaaaaacttcagatcgcgcacaacacgctctgatcagacacttcgcgatagaatcttggaggtgatcataagagcggggtcccatgttgatgctatacaattcgtgtacgatcatgcgaatccaaattctacgactctggggactctggctggaaacgccacgggaggaaataggcatcaggttgatgtgagggatccgcccatacaggaattgcgcatggagttcgctcgggatgtgcttgcttcgttgcagcttcattttgaggatggtacatcaacacagaaattcggcaatgtactttttggtacttgggcgactagaatactaacttgtacagcgccctatggctacagattcagctcatgggcctttcgtgaagatcccggcccctatggaacaaccgccatcagtgtactccgcttccaattcacccccgagctggatatgcccttgccagcatcttatatgatctta

SEQ ID NO: 149 - DNA, 1566 bp, Asplenium antiquum
atggcaggctataatcacgtgcaggatcaacagctagtgatggcagctgagggcgttgaaactgtttctgagcttgctcccgctactgacaaggtgcagaacgcagacatggccgaagaggacccaatttttgcgcaattagcgcagaagatggctgctgctgcagaggaggaggaggtccccgtagatcttcttgcccaatacatgcaagtggaggctcatgactggcataaccgggtcagaggcgccatactggggctgatatccgcagtgccgaaggtgggtgctgctataagcaggctcatcggcctcttctggccagcaaacaaggtggacatttgggaggccctcaagttggaggaatatatcgggaacattgtccagcaggagctttttgaattcgaattgcggctccttgagaacgacatccaagcgctggaaaccactgttgggagatacgatacggctgctgcacttactgaaaaggggaactttctaagcatctggatctcgcaagctgatgcattgtatattcggatgcgaaactctaccaacaacatccaacttctccttcacatggtcaccgtgtctacacttcatctcgcagccctgcatgagcgactgacaattggcgaggaactgtatggctcaaacaattcagcgaattggacgcaagatctcgtggacaagttcgagaggtacacagccgatttaatcccgaatgttttcaaaaggtggaaggaatggaggccaacccagatcgagattagagcatgggtacgcaggggctcgtgcggcgttgttacctgtagaccagacgtttctttcgctacagtggaggacaagatctccggggcattattctcatttcaggcagcaaatcgaaactcgacaacaattttcttagaagtttgcgaagaccacaaaactcggatggtgaacgaggccattgcggacatggcgagctgcctgtcacccacttttgctttccacaagctcctacccgacgatattcaggcgcagttctctccttacgatcggcagcagttcggacaggttttcagaggcccatattcccaggatctttcgcacggactctggacggttttcaaatccttcagatcgcgcacaacacgctctgatcagacacggcgcgatagaatcctggaggtgatcataagagcggggcaccatgttgatgctatacagttcatgtacgatcatgcgaatccaaatcttacgactccggggactgtggctggaaacgccgcgggaggaagtaggcatcaggttgatgtgaggaatcgacccatacaggaagtgcgcatggagttctctcaggatgtgcttgcctcgttgcagctccattttgaggatggtacatcaacacggaaattcggcaatgaacttggttgggcgactagaatactaacttgtacagcgccctatggctacaggttcagctcatgggcctttcgtgaagatcccggcccctacagaacaaccgccatcagtgtactccgcttccaattcacccccgagctggatatgcccttgccaaatata

SEQ ID NO: 150 - DNA, 1572 bp, Doryopteris cordata
atggcagctgagggcgttaaatatactggatctgagcttgctactcccgctgctgaagagatgcagaagaacgtcctggcaccagctgctatggacatgcaggaggccgaggaggacccaatttttgcacagttagcgcaggagatgcagctcgctgctgcgaaggggcaggacatccccgtggtagatctgatagaaaaatacatgcaagtgcaggctcacgactggcataaccggattagaggcgccatcctagggctcatatccttagtgccgacggtgggtagggcggtcagcaggctcatcggcctcttttggccagccaacagggtggacatttgggaggccctcaagttggagcaatatatccggaacattgtccagcaggagatttttgactttgaaatgcagctgcttcgctctgacatcgaagcgctggaaaccaccgttgcgagatatgatatggctgcccttaatgagaaggggaactttctgagcatttggatctcacaagctgacgcattgtattttcgtatgcggaactctacgaacaacatccaccttctcctccacattgtcacagtgtctacgctacatctcgcagccctgcatgagcgattgacatttggcgaggaactctatggtacaaacaatgcagcaaattggacacaagatcttgtgaatatgttcagactatacacagttgatttgatcccaagtatctttaaaaggtggaaggaatggagggaagcccagattgagattagagcatgggtaaacaggggctcctgcggcaatcttatttgtagaccaaatgtttctcatgctaccgtggaggataaaatctcaggggcgagagtcacgtttcaggcaaccaatcagaactcgacgacgatcttctcagcaatttgcgaagatcacaaaactcggatggtgaatgaggccgttgccgacatggccagctgcctgtcgcccacctttgcttttcacaagctcctaccggacaacattcaggcgcagttctctgcttacgatagggagcagttcgggcgggttttcagaggcccatattcgcaggatctttcgcatggagcatggacgtctctgaaatccttcagatcgcgtccgacgagattcgatcagacagcgcgcgacagaatcttggaggtgatcataagagcggggtctcatattgatgctattcagttttggtacgaccatgcgaatgcaaattctatgactgcaggagttatggctggaaacccttcgggagggagtaggtatcaggttgatgtgaggggtcgcctcatacaggatttgcgcatggagttctctcgggacgtacttgctgcattgcaactgcgtttcatagatggcatatctacacagaatttcggcaacgccaatggtgggataactcgagacgtaacttgtacagccccctatggctacaggctcagctcatgggccttccgcgaagatacaggcccctacggaacggccgccatcagcgtgctccgcttccagttcaccccggagctggattttcccgtgccagaagaatacagcgtc

SEQ ID NO: 151 - DNA, 1494 bp, Asplenium ebenoides
atggcagcgccgggaatgaaggactcggaagtgattgctgacgtcgttactactcctgtgtctgctgtgcctgatgaggaggtgcaggaactggataaattggggctgcaggaggtagccgataacatagatgtacttgcgaaatacatgcaaacggaggctcatgactggcataaccggacgagaggtgccgtactggggatcatatccgcaataccgaaggtgggtgctgccataagcatgctcatcggcctgttttggccagcgaacaaggttgatatctgggtggccctcaatgcggaggaatatgttagaaacattgtcaggcaggagattttcgaattcgaaatgcagcaacacaagtccgaaatcgaggcgttggaagccgctatttccagatacgatacggctgcgcttactgagaagggaaattttctaagcatctggatctggcaagctgacagactgtgtattcagctgcgaaactccgccaacagaatccaccttctccttcacatagtcaccgtggctgtgcttcatatcgccgccatgcatgagcgatttacatttggcgaggagatctacggcacaaacaatacagcagcttggaggaaagattttgtggatgtgttcgagatgtacacatccaatatagtcccaaatctcttcaaggagtggaggcagtggagggaaagccagattgagattaaagcatgggtagtaaggggtgtatggggtaatattacttccaccccagacgtttctcatgcaacagtggaggataagatctcaggggagaaattcgcgtttcgggtagcgaggcgaaattcaacaacgattttctcagctatttgcgaagatcacaaaactcggatgttgaatgaggccattgcagacatggccgcctgcttgtcacccacttttgcttttcacaagctcctaccgaacgatacccaaatgcaattatctccttatgataaggagctgttcgggcaagtttttcgaggcccatattcacatgatcttttgcagccactcttcacagctctcaaatccttcagatcacgtccaactcgctttgatcaaacggctcgcgacaaaatcttggaggtgactatccgagcggggcaccatgttgatgctatacaattttggtacgatcatgtaaattcaaatgctatgactgcgggaattgtggccggaaactctgcaggggggagtaggcatcaagttgatgtgaggaatcgacgcatacaagatttgcgcttggagttttctagagatgtgcttgcttcgttgcaacttcatttcgaagatggtacatcaacacgaaaatttggcaatgaagcgggctgggctactaatatagtaacttgtacgaccccctctggctacaggctgagctcatgggcctttcgtgaggatcccggcccctacaacacaaccgccatcagtgtactccgcttccaattcaccccagaggatccctcgtca

SEQ ID NO: 152 - DNA, 1494 bp, Asplenium ebenoides
atggcagcgccgggaatgaaggactcggaagtgattgctgacgtcgttactactcctgtgtctgctgtgcctgatgaggaggtgcaggaactggataaattggggctgcaggaggtagccgataacatagatgtacttgcgaaatacatgcaaacggaggctcatgactggcataaccggacgagaggtgccgtactggggatcatatccgcaataccgaaggtgggtgctgccataagcatgctcatcggcctgttttggccagcgaacaaggttgatatctgggtggccctcaatgcggaggaatatgttagaaacattgtcaggcaggagattttcgaattcgaaatgcagcaacacaagtccgaaatcgaggcgttggaagccgctatttccagatacgatacggttgcgcttactgagaagggaaattttctaagcatctggatctggcaagctgacagactgtgtattcagctgcgaaactccgccaacagaatccaccttctccttcacatagtcaccgtggctgtgcttcatatcgccgccatgcatgagcgatttacatttggcgaggagatctacggcacaaacaatacagcagcttggaggaaagattttgtggatgtgttcgagatgtacacatccaatatagtcccaaatctcttcaaggagtggaggcagtggagggaaagccagattgagattaaagcatgggtagtaaggggtgtatggggtaatattacttccaccccagacgtttctcatgcaacagtggaggataagatctcaggggagaaattcgcgtttcgggtagcgaggcgaaattcaacaacgattttctcagctatttgcgaagatcacaaaactcggatgttgaatgaggccattgcagacatggccgcctgcttgtcacccacttttgcttttcacaagctcctaccgaacgatacccaaatgcaattatctccttatgataaggagctgttcgggcaagtttttcgaggcccatattcacatgatcttttgcagccactcttcacagctctcaaatccttcagatcacgtccaactcgctttgatcaaacggctcgcgacaaaatcttggaggtgactatccgagcggggcaccatgttgatgctatacaattttggtacgatcatgtaaattcaaatgctatgactgcgggaattgtggccggaaactctgcaggggggagtaggcatcaagttgatgtgaggaatcgacgcatacaagatttgcgcttggagttttctagagatgtgcttgcttcgttgcaacttcatttcgaagatggtacatcaacacgaaaatttggcaatgaagcgggctgggctactaatatagtaacttgtacgaccccctctggctacaggctgagctcatgggcctttcgtgaggatcccggcccctacaacacaaccgccatcagtgtactccgcttccaattcaccccagaggatccctcgtca

SEQ ID NO: 153 - DNA, 1620 bp, Adiantum venustum
atgatcagtacatatttcgacgggaaatttatctttggattgatactgataatggcaggatatcaagtgcaggatcaattagctgtaatggcagctgagaacgtgaattctgtggttgctctgcctgttgagaaggtccagctggacggcgcagacatggaggaggacccaatttttgcgaaactagcgcaagagatggtcgctgctgctgctgcggagggacggcaagaggtccccgtcgatctgcttgccagatacatgcaagtggaggctcatgactggcataaccggattagaggcgctgtactggggctcatatccgtggtgccgaaggtgggtgctgccataagcaggctcatcggcctcttttggccagcaaacaaggtggacatttgggaagccatcaaagcggaggagtatataaggaacattgtccagcaagagattttcgaattcgaaatgcagcaacttcggaacgacatcgaagcgctggaaaccactgttgcgagatacaatacggctgtgctcaatgagaaggggaattttctaagcatctggatctcgcaggctgacgcattgttcattcggatgcgaaactctcccaacaggatccaccttctccttcacattgtcaccgtgtctacgctccatgtcgcagccctgcatgagcgaatgacatttggagaggaactctacggctcaaacaatacagcaaactggacgcaagatctggtgactgtgttcgagaggtacacaaccgatttaatcccaaatgtcttcaaaagctggaaggagtggagggaaacccagattgagattacagcatgggtacggaggggcacatgcgggaatcttatgtgtagaccagacgtttcttttgctcaagtggaggataaggtctcaggggcgatattctcatttcaggcaaccaatcgaaactcaacaacaatcttcttgggagtttgccaagatcacaaaattcggatgacgaacgaggcgactgcggacatggccagctgcctgtcgcccacttttgcattccacaagctcctacccgaccatattcagacgcagttttctccttatgacagggagcagttcgggcgggttttcagaggcccatattcccaggatctttcgcacggattctggacggttctcaaagccttcagatcgcatccaactcgctttgatcagacggctcgcgacagaattttggagatgacaatcagagcggggtcccatgttgatgctatacaattttggtacgatcatgtgaattcaaattctatgactcctgggattatggccggaaactctatgggggggattaggcatcaggttgatgtgaggggtcggccaatacaggaaatacgcatggagttcgctcgtgacgtgcttgcttcgttgcaacttcatttcgaagatggtacatcaacaccggaatttggcaatgatggatgggcgactagaatattaacttgtacagccccctatggctacaggttcagctcatgggcctttcgtgaagatcccggcccctacggaacaaccgccatcagtgtactccgcttccaattcacccccgaggacgtaattatccccccagacgagcagcta

SEQ ID NO: 154 - DNA, 1569 bp, Adiantum venustum
atggcaggatatcaagtgcaggatcaattagctgtaatggcagctgagaacgtgaattctgtggttgctctgcctgttgagaaggtccagctggacggcgcagacatggaggaggacccaatttttgcgaaactagcgcaagagatggtcgctgctgctgctgcggagggacggcaagaggtccccgtcgatctgcttgccagatacatgcaagtggaggctcatgactggcataaccggattagaggcgctgtactggggctcatatccgtggtgccgaaggtgggtgctgccataagcaggctcatcggcctcttttggccagcaaacaaggtggacatttgggaagccatcaaagcggaggagtatataaggaacattgtccagcaagagattttcgaattcgaaatgcagcaacttcggaacgacatcgaagcgctggaaaccactgttgcgagatacaatacggctgtgctcaatgagaaggggaattttctaagcatctggatctcgcaggctgacgcattgttcattcggatgcgaaactctcccaacaggatccaccttctccttcacattgtcaccgtgtctacgctccatgtcgcagccctgcatgagcgaatgacatttggagaggaactctacggctcaaacaatacagcaaactggacgcaagatctggtgactgtgttcgagaggtacacaaccgatttaatcccaaatgtcttcaaaagctggaaggagtggagggaaacccagattgagattacagcatgggtacggaggggcacatgcgggaatcttatgtgtagaccagacgtttcttttgctcaagtggaggataaggtctcaggggcgatattctcatttcaggcaaccaatcgaaactcaacaacaatcttcttgggagtttgccaagatcacaaaattcggatgacgaacgaggcgactgcggacatggccagctgcctgtcgcccacttttgcattccacaagctcctacccgaccatattcagacgcagttttctccttatgacagggagcagttcgggcgggttttcagaggcccatattcccaggatctttcgcacggattctggacggttctcaaagccttcagatcgcatccaactcgctttgatcagacggctcgcgacagaattttggagatgacaatcagagcggggtcccatgttgatgctatacaattttggtacgatcatgtgaattcaaattctatgactcctgggattatggccggaaactctatgggggggattaggcatcaggttgatgtgaggggtcggccaatacaggaaatacgcatggagttcgctcgtgacgtgcttgcttcgttgcaacttcatttcgaagatggtacatcaacaccggaatttggcaatgatggatgggcgactagaatattaacttgtacagccccctatggctacaggttcagctcatgggcctttcgtgaagatcccggcccctacggaacaaccgccatcagtgtactccgcttccaattcacccccgaggacgtaattatccccccagacgagcagcta

SEQ ID NO: 155 - DNA, 1620 bp, Arachniodes standishii
atggcagcgcccggcatgatggactcagaagtgatcgctgaggacgttaatactgtttctgtgcttgctccggctgctaagaaggtgcaggatgatcaattcgtaacgacagagccagactcagtttatctgcaattagcgcaagagatgatcgatgacgtcgttaatattgtttctgcgcctgttgctgctggtgctgaggagggtcagaaggtcaccgtagatctgcttgccaaatacgtgctactcggggctcatgactggaataaccggattagagaggttatactggggctggcatccttaatcccaaaggtgggtggtggcgtacgcctgctcatcagcatcttttggccagcacacaaggtggacatttggcaggccatcaatggggagcaatatgttaggaacattgttaggcaggagatttttgaattcgaattgcagcaatatcggtccgacatcgaggcgctgcaaaccactattttgagatacgatacggctgcgcctattattgagaaggggaattttctaagcatctggatctcgcaagctgacaaattgtgtgttcggttgcgaaactctcccaacaacatccaccttctccttcacattgtcaccgtggctgcgcttcatgtcgcagccatgcatgagcgactgacatttggcaaggaactctatggctcagacaatacagcaaattggaagcaagatcttgtggatgtgttccagatgtacacatccaatttaatcccaaatctctttagaaactggaagcagtggagggaaagccagattgagattaaagcatgggtagtacccggcagatggggcaatcttgtaatgactaccccagacgtttctcatgctacagtggaggataagatctcaggggagaaattcacgtttcgggtagtcagacgaaactcaacaacaattttctcaggagtttgccaagatcacaaaactcggatggggaatgaggcgattgcagacatggccagctgcatatcacccacttttgcttttcacgagctcctacccgacgatattcaggcgcagttctctccttatgataaggaactgttcgggcaggttttcagaggcccatattcccaggatcttttgcagcgatccttcacgggtctcaaagacttcagatcgcgtccaactcgctttgatcagacgactcaagacagaatctgggaggtgatcataagagcggggcaccatgttgatgctatacaattttggtacgagaatgcgaatccatatgctatgactgcagggactatggccggaaactcggcgggggggattagtcatcgggttaatgtgatgaatcggcccatagaggaattgcgcatggagttctctcatgacgtgcttgcttcgatgcaacttcatttcaaagatgatacatcgacacagaaatttggcaatcaacttggttgggcgtctaatatagtaacttgtacagccccctctggctacaggctcagctcctgggcctttcgtgaagatcccggtccctacagcacaactgccatcagtatactccgcttccaattcaccccctatgagaaccaggagatgaggagcccgatggccgtaggaggt

SEQ ID NO: 156 - DNA, 1608 bp, Adiantum venustum
atgatcagtacatatttcgacgggaaatttatctttgggttgatactgataatggcaggatatcaagtgcaggatcaattagctgtaatggcagctgagaacgtgaattctgtggttgctctgcctgttgagaagggcgcagacatggaggaggacccaatttttgcgaaactagcgcaagagatggtcgctgctgctgctgcggagggacggcaagaggtccccgtcgatctgcttgccagatacatgcaagtggaggctcatgactggcataaccggattagaggcgctgtactggggctcatatccgtggtgccgaaggtgggtgctgccataagcaggctcatcggcctcttttggccagcaaacaaggtggacatttgggaagccatcaaagcggaggagtatataaggaacattgtccagcaagagattttcgaattcgaaatgcagcaacttcggaacgacatcgaagcgctggaaaccactgttgcgagatacaatacggctgtgctcaatgagaaggggaattttctaagcatctggatctcgcaggctgacgcattgttcattcggatgcgaaactctcccaacaggatccaccttctccttcacattgtcaccgtgtctacgctccatgtcgcagccctgcatgagcgaatgacatttggagaggaactctacggctcaaacaatacagcaaactggacgcaagatctggtgactgtgttcgagaggtacacaaccgatttaatcccaaatgtcttcaaaagctggaaggagtggagggaaacccagattgagattacagcatgggtacggaggggcacatgcgggaatcttatgtgtagaccagacgtttcttttgctcaagtggaggataaggtctcaggggcgatattctcatttcaggcaaccaatcgaaactcaacaacaatcttcttgggagtttgccaagatcacaaaattcggatgacgaacgaggcgactgcggacatggccagctgcctgtcgcccacttttgcattccacaagctcctacccgaccatattcagacgcagttttctccttatgacagggagcagttcgggcgggttttcagaggcccatattcccaggatctttcgcacggattctggacggttctcaaagccttcagatcgcatccaactcgctttgatcagacggctcgcgacagaattttggagatgacaatcagagcggggtcccatgttgatgctatacaattttggtacgatcatgtgaattcaaattctatgactcctgggattatggccggaaactctatgggggggattaggcatcaggttgatgtgaggggtcggccaatacaggaaatacgcatggagttcgctcgtgacgtgcttgcttcgttgcaacttcatttcgaagatggtacatcaacaccggaatttggcaatgatggatgggcgactagaatattaacttgtacagccccctatggctacaggttcagctcatgggcctttcgtgaagatcccggcccctacggaacaaccgccatcagtgtactccgcttccaattcacccccgaggacgtaattatccccccagacgagcagcta

SEQ ID NO: 157 - DNA, 1581 bp, Blechnum medium
atggcagccttggatcacacgaaggactcagaaattatcgctggccgcgccgtcgctactgatcatgatccagctactgttgtttctgaggaggactcggaaacgaagattgctgaagtggcttgtgatccagctactgctggtgatcccgctggggaagtgcatgaactggacaaactggcgctggagtgcggtagcgacggcatcgacttgcttgccaagcgcatgcaagtggacgcccacgactggcataaccggttgagaggcgctgtgctggggctcctatccgatctcccgttgggtggtgccatcagcaccctcgtcggcctcttttggccagcgacccgggtgaacatctgggaggccctgggcatggaggcatatgttaccaacattgtccggaaggagatctttgagttcgaaatgaggcagcacgagtccgacattgaggcgctggaaagaagcattctgagatatgagaggggcttgcttactgagaaggcgactgccctaggcatctggatcgcacaagccgacgcactgtctattcggttgggaaactccaccaacaggattcatcttctcctccatatcgtcaccgtggccgtgctccatatggccgcattgcacgagcgactgacatttggcgaggaaatttacggcgcaaacaatacagcaaattggacaaaagaactcgaagaaacgttccagaggtacacgtccgatcggatcccagttatcttcaaggagtggaggccgtggagggaaagccagattgagatcagggcatggaggagacgggcaagcggcatggttatttttaacccagatgcttcgtttgcgacagtggaggacaagatttcaggggcgatattcaatttcagtgtgaactatcactactcgatgtcgattttctcggatatttgtgaagctcacaaagcaaggatgatgaatgaggccaatgcagacatggccagttgcatgtcgcccacttttgcttttcacaagctcctacccggcgacagtcaaagcaaattctctccttacgataggcagctcttcgggcaagtctttcgagggccattttcacaggatcttctgcagccgcgcttcacgagcctcaagaccttcaggatgcacccaactcgttccgatattatgttgggcactagagtcttgcaggtgaatgtaagagctgggacccttcttgaatcgatacaatttgtgtactatcatccgtcgagtccaaatggaatcccgaattgggggaatattgccggaaacccgagagggggggagagcttcgtcgttgatgtgaggacgcgtcacatacaggatttgcgcttggagttctctcgagatgtgcttgtttcgctgcagatccggttcgaagatggtacgtccacccaaaaattcggcaatgcgaccgggtgggctactagtgcagtaacttgtaccgccccctctggctacacgctcaactcatgggactttcgtgaagacccaggccccaacggtacaactgccatcagcgtcgccggctacggattcacccccgacgatattcgcttgcctcctgca

SEQ ID NO: 158 - DNA, 1536 bp, Dryopteris intermedia
atggcactagcgcgccccgccatgatgcactcagaaatgatcgctgagggcgttaataatagtgctccgcttgctgaggatgatattcagcagctgcaggactcagtctatacgcaattagcgcaacagatgatcgctgacgctcatcatgaggaaggtgggcaggaggtcgatctgcttgccaaatacatgcaaaccgaggctcatgactggcataaccggactagaggcgctatactggggctgctatccgcaatcccgaaggtgggtgctggcataagcatgctggtcggcctcttttggccagcaaacagggtgagcgtttgggaggccatcaatggggagaaatatgttaagaacattgtcaggcaggagctttttgaattcgaaatgaatcaacatcggtccgaaatccaggcgctggaaaccacggtttccagatacaacacggctggtgggcttactgagagggggaattttctaagcatctggatcacgcaagctgacagagtgtcttttctgttgcaaaactctaccaacaacatccaccttctccttcacattgtcaccgtggctgtgcttcatgtcgcagccctgcatgagcgactgacatttggcgaggaactctacggccaagcaaatacagcacaatggacgcaagatcttgtggatgtgttcgagatgtacacatccaaagtagtcccaaatgtcttcaacaagtggaagcagtggagggaaagccagattgagattagagcatggacagtaagcgcctcatggggcaatcttactggtagaccaagcagttctcatgctacagtggaggataagatctcaggggagatattcacgtttcgggtaaccaatcgacagtcaacaacaattttctcagaagtttgccaagatcacaaaactcggatggtgaatgaggccactgcggacatggccagctgcttgtcacccacctttgcttttcacaagctcttgccggacgatgttcaggcgcggttctctccttatgatcaggggctgttcgggcgggttttcagaggcccatattcccaggatcttttgcaggggctcttcacgacactcaaagccttcagatcgcgtgcaactcgctttgatcagacgacccgcgacagagtcttggaggtggtcataagagcggggagccatgtggatgctatacaattctggtacgatcattcgaatccaaatgctgtgactcaagggattatggccggacaccctgcgggggggaataggcatcaggtgaatgtgagggatcggcccatacaggaattgcgcatggggttcgctcgtgacgtgcttgcttggttgcagcttcatttggaagatggtacatccacacagcaatttggcagtactggctgggcgtctaatatcgtaacctgtacagccccctatggctacaggctcagctcatgggcctttcgtcaagatcccggcccctacagcacacccgccatcagtgtactgcgcttccaattcacccccgacgatattcgtgtg

SEQ ID NO: 159 - DNA, 1536 bp, Dryopteris intermedia
atggcactagcgcgccccgccatgatgcactcagaaatgatcgctgagggcgttaataatagtgctccgcttgctgaggatgatattcagcagctgcaggactcagtctatacgcaattagcgcaacagatgatcgctgacgctcatcatgaggaaggtgggcaggaggtcgatctgcttgccaaatacatgcaaaccgaggctcatgactggcataaccggactagaggcgctatactggggctgctatccgcaatcccgaaggtgggtgctggcataagcatgctggtcggcctcttttggccagcaaacagggtgagcgtttgggaggccatcaatggggagaaatatgttaagaacattgtcaggcaggacctttttgaattcgaaatgaatcaacatcggtccgaaatccaggcgctggaaaccactgtttccagatacaacacggctggtgggcttactgagagggggaattttctaagcatctggatcacgcaagctgacagagtgtcttttctgttgcaaaactctaccaacaacatccaccttctccttcacattgtcaccgtggctgtgcttcatgtcgcagccctgcatgagcgactgacatttggcgaggaactctacggccaagcaaatacagcacaatggacgcaagatcttgtggatgtgttcgagatgtacacatccaaagtagtcccaaatgtcttcaacaagtggaagcagtggagggaaagccagattgagattagagcatggacagtaagcgcctcatggggcaatcttactggtagaccaagcagttctcatgctacagtggaggataagatctcaggggagatattcacgtttcgggtaaccaatcgacagtcaacaacaattttctcagaagtttgccaagatcacaaaactcggatggtgaatgaggccactgcggacatggccagctgcttgtcacccacctttgcttttcacaagctcttgccggacgatgttcaggcgcggttctctccttatgatcaggggctgttcgggcgggttttcagaggcccatattcccaggatcttttgcaggggctcttcacgacactcaaagccttcagatcgcgtgcaactcgctttgatcagacgacccgcgacagagtcttggaggtggtcataagagcggggagccatgtggatgctatacaattctggtacgatcattcgaatccaaatgctgtgactcaagggattatggccggacaccctgcgggggggaataggcatcaggtgaatgtgagggatcggcccatacaggaattgcgcatggggttcgctcgtgacgtgcttgcttggttgcagcttcatttggaagatggtacatccacacagcaatttggcagtactggctgggcgtctaatatcgtaacctgtacagccccctatggctacaggctcagctcatgggcctttcgtcaagatcccggcccctacagcacacccgccatcagtgtactgcgcttccaattcacccccgacgatattcgtgtg

SEQ ID NO: 160 - DNA, 1536 bp, Dryopteris intermedia
atggcactagcgcgccccgccatgatgcactccgctgagggcgttaataatagtgctcctccgcctgctgaggatgatattcagctgcagctgcaggactcagtctatacgcaattagcgcaacagatgatcgctgacgctcatgatcatgaggaaggtgggcaggaggtcgatctgcttgccaaatacatgcaaaccgaggctcatgactggcataaccggactagaggcgctatactggggctgctacgcgcaatcccgaaggtgggtgctggcataagcatgctggtcggcctcttttggccagcaaacaaggtgagcgtttgggaggccatcaatggggagaaatatgttaagaacattgtcaggcaggagctttttgaattcgaaatgaatcaacatcggtccgaaatccaggcgctggaaaccactgtttccagatacaacacggctggtgggcttactgagagggggaattttctaagcatctggatcacgcaagctgacagagtgtcttttctgttgcaaaactctaccaacaacatccaccttctccttcacattgtcaccgtggctgtgcttcatgtcgcagccctgcatgagcgactgacatttggcgaggaactctacggccaagcaaatacagcacaatggacgcaagatcttgtggatgtgttcgagatgtacacatccaaagtagtcccaaatgtcttcaacaagtggaagcagtggagggaaagccagattgagattagagcatggacagtaagcgcctcatggggcaatcttactggtagaccaagcagttctcatgctacagtggaggataagatctcaggggagatattcacgtttcgggtaaccaatcgacagtcaacaacaattttctcagaagtttgccaagatcacaaaactcggatggtgaatgaggccactgcggacatggccagctgcttgtcacccacctttgcttttcacaagctcttaccggacgatgttcaggcgcggttctctccttatgatcaggggctgttcgggcgggttttcagaggcccatattcccaggatcttttgcaggggctcttcacgacactcaaagccttcagatcgcgggcaactcgctttgatcagacgacccgcgacagagtcttggaggtggtcataagagcggggagccatgtggatgctatacaattctggtacgatcattcgaatccaaatgctgtgactcaagggataatggccggacaccctgcgggggggaataggcatcaggtgaatgtgagggagcggcccatacaggaattgcgcatggggttcgctcgtgacgtgcttgcttggttgcagcttcatttggaagatggtacatccacacagcaatttggcagtactggctgggcgtctaatatcgtaacttgtacagccccctatggctacaggctcagctcatgggccttccgtgaagatcccggcccctacagcacacccgccatcagtgtactgcgcttccaattcacccccgacgatattcgtgtg

SEQ ID NO: 161 - DNA, 1569 bp, Ophioglossum pendulum
atgttatctagtggagtgtatgtctctctagaagatcaacagttagtgatggcagctcagggcgttgaaactctttctcagcttgctcccgctaccgacaaggtgcagaactcagacatggccgaagaggacccaatttttacgcaattagcaaagaagatggctgttgctgcagagaaggaggaggtccccgtagatcttctcgcccagtacatgcaagtggaggctcatgattggcataaccgggtcagaggcgccatactggggctgatatccgcagtgccgaaggtgggtgctgccataagcaggctcatcggtctcttttggccagcaaacaaggtggacatttgggaggccctcaagttggaggaatatatcaggaacattgtccagcaggagctttttgagttcgaattgcggctccttgagaacgacatccaagcgctggaaaccactgttgggagatacgatatggctgcacttactgaaaaggggaactttctaagcatttggatctcgcaagcagatgcattgtatattcggatgcggaactctaccaacaacatccaccttctacttcacatggtcaccgtgtctacacttcatctcgcagccctgcatgagcgactgacatttggcgaggaactgtatggcacaaacaattctgtaaattggacgcaagatctcgtggaaaagttcgagaggtacacagccgatttaatcccgaatgttttcaagaggtggaaagaatggaggccaacccagatcgagattagagcatgggtacgcaggggctcctgcggcaatcttgtctgtagaccagacgtttcttatgccacagtggaggacaagatctccggggcattattctcatttcaggcaacaaatcgaaactcgacaacaattttcttagaagtttgcgaagaccacaaaactcggatggtgaacgaggccattgcggacatggcgagctgcctgtcacccacttttgccttccacaagctcctacccgacaatattcaggcgcagttctctccttacgatcggcagcagttcggacaggttctcagaggcccatattcccaggatctttcgcacggactgtggacggttttcaaatccttcagatcgcgcacaacacgctctgatcagacacttcgcgatagaatcttggaggtaatcataagagcggggcaccatgttgatgctatacagttcgtgtacgatcatgcgaatccaaatcttacgactccggggactgtggctggaaacgctgcgggaggaaacacgcatcaggttgatgtgagggatcgacccatacaggaagtgcgcatggagttctcgcaggatgtgcttgcttcgttgcaactccactttgaggatggtacatcaacacggaaattcggcgatgaacttggttgggcgactagaatactaacttgtacagcgccctatggctacaggttcagctcatgggcctttcgtgaagatcccggcccctacagaacaaccgccatcagtgtactccgcttccaattcacccccgagctggatatgcccttgccaata

SEQ ID NO: 162 - DNA, 1569 bp, Ophioglossum pendulum
atgttatctagtggagtgtatgtctctctagaagatcaacagttagtgatggcagctcagggcgttgaaactctttctcagcttgctcccgctaccgacaaggtgcagaactcagacatggccgaagaggacccaatttttacgcaattagcaaagaagatggctgttgctgcagagaaggaggaggtccccgtagatcttctcgcccagtacatgcaagtggaggctcatgattggcataaccgggtcagaggcgccatactggggctgatatccgcagtgccgaaggtgggtgctgccataagcaggctcatcggtctcttttggccagcaaacaaggtggacatttgggaggccctcaagttggaggaatatatcaggaacattgtccagcaggagctttttgagttcgaattgcggctccttgagaacgacatccaagcgctggaaaccactgttgggagatacgatatggctgcacttactgaaaaggggaactttctaagcatttggatctcgcaagcagatgcattgtatattcggatgcggaactctaccaacaacatccaccttctacttcacatggtcaccgtgtctacacttcatctcgcagccctgcatgagcgactgacatttggcgaggaactgtatggcacaaacaattctgtaaattggacgcaagatctcgtggaaaagttcgagaggtacacagccgatttaatcccgaatgttttcaagaggtggaaagaatggaggccaacccagatcgagattagagcatgggtacgcaggggctcctgcggcaatcttgtctgtagaccagacgtttcttatgccacagtggaggacaagatctccggggcattattctcatttcaggcaacaaatcgaaactcgacaacaattttcttagaagtttgcgaagaccacaaaactcggatggtgaacgaggccattgcggacatggcgagctgcctgtcacccacttttgccttccacaagctcctacccgacaatattcaggcgcagttctctcctcacgatcggcagcagttcggacaggttctcagaggcccatattcccaggatctttcgcacggactgtggacggttttcaaatccttcagatcgcgcacaacacgctctgatcagacacttcgcgatagaatcttggaggtaatcataagagcggggcaccatgttgatgctatacagttcgtgtacgatcatgcgaatccaaatcttacgactccggggactgtggctggaaacgctgcgggaggaaacacgcatcaggttgatgtgagggatcgacccatacaggaagtgcgcatggagttctcgcaggatgtgcttgcttcgttgcaactccactttgaggatggtacatcaacacggaaattcggcaatgaacttggttgggcgactagaatactaacttgtacagcgccctatggctacaggttcagctcatgggcctttcgtgaagatcccggcccctacagaacaaccgccatcagtgtactccgcttccaattcacccccgagctggatatgcccttgccaata

SEQ ID NO: 163 - DNA, 1569 bp, Ophioglossum pendulum
atgttatctagtggagtgtatgtctctctagaagatcaacagttagtgatggcagctcagggcgttgaaactctttctcagcttgctcccgctaccgacaaggtgcagaactcagacatggccgaagaggacccaatttttacgcaattagcaaagaagatggctgttgctgcagagaaggaggaggtccccgtagatcttctcgcccagtacatgcaagtggaggctcatgattggcataaccgggtcagaggcgccatactggggctgatatccgcagtgccgaaggtgggtgctgccataagcaggctcatcggtctcttttggccagcaaacaaggtggacatttgggaggccctcaagttggaggaatatatcaggaacattgtccagcaggagctttttgagttcgaattgcggctccttgagaacgacatccaagcgctggaaaccactgttgggagatacgatatggctgcacttactgaaaaggggaactttctaagcatttggatctcgcaagcagatgcattgtatattcggatgcggaactctaccaacaacatccaccttctacttcacatggtcaccgtgtctacacttcatctcgcagccctgcatgagcgactgacatttggcgaggaactgtatggcacaaacaattctgtaaattggacgcaagatctcgtggaaaagttcgagaggtacacagccgatttaatcccgaatgttttcaagaggtggaaagaatggaggccaacccagatcgagattagagcatgggtacgcaggggctcctgcggcaatcttgtctgtagaccagacgtttcttatgccacagtggaggacaagatctccggggcattattctcatttcaggcaacaaatcgaaactcgacaacaattttcttagaagtttgcgaagaccacaaaactcggatggtgaacgaggccattgcggacatggcgagctgcctgtcacccacttttgccttccacaagctcctacccgacaatattcaggcgcagttctctccttacgatcggcagcagttcggacaggttctcagaggcccatattcccaggatctttcgcacggactgtggacggttttcaaatccttcagatcgcgcacaacacgctctgatcagacacttcgcgatagaatcttggaggtaatcataagagcggggcaccatgttgatgctatacagttcgtgtacgatcatgcgaatccaaatcttacgactccggggactgtggctggaaacgccgcgggaggaaacacgcatcaggttgatgtgagggatcgacccatacaggaagtgcgcatggagttctcgcaggatgtgcttgcttcgttgcaactccactttgaggatggtacatcaacacggaaattcggcaatgaacttggttgggcgactagaatactaacttgtacagcgccctatggctacaggttcagctcatgggcctttcgtgaagatcccggcccctacagaacaaccgccatcagtgtactccgcttccaattcacccccgagctggatatgcccttgccaata

SEQ ID NO: 164 - DNA, 1530 bp, Pellaea falcata
atggcagctaaggatgtttctgagcttgctcccgctgctgatgacgaggtgcagaacgcagacgaggaggacccaattttctcgcaattagcgcagaagatggtcgctgctgcggaggcgggggaggtccccgtggtcgaccttcttgcccaatacaggcatgtggaggcgcacgactggcataaccggatcagaggcgccgtactcgctctgatagccttagtgccgaaggtgggcgctgccataagcaagctcgtcggcctcttttggcctgcaaaccgggtgaacatttgggaggccctgaatgcggagcaatatatcaggaacattgtccagcaggagatctttgaattcgaaatgcagctcctgcggagcgacatccaagcgctggaaaccactgttgcgagatacgatagggccgctgcgctcaatgagaaggggaatttcctaagcatctggatctcgcaagctgatgcactgtatagtcggatgcgaaactctgccaacaacatccaccttctccttcacatggtcaccgtgtctacgctacatctcgcagccctgcatgagcgaatgacatttggccaggaactctatggcacgaacaattcagcgaattggacgcaagatcttgtcgataagttcgcgctgtacacaaccgatttgatcccgagtgttttcaaaaggtggaaggactggaggccaacccaaatcgagattacagcttggacacgaccgggcagttgcagcaatgttatgggctgtggtccaaacatgtcttatgctagagtggaggataaggtctccggggcaatattcacgtttcaggcaaggaatcagctttcaacaacaattttctcaggaatttgtcaagatcacagaactcggatggtgaacgaggccattgctgacatggccagctgcctgtcacccacttttgcttttcacaggctcctacccgcctacattcagccgcggttctccgcttttgatagggagcagttcggacaggttttcagaggcccatattccgaggatctttcgcacggagcctggtttcatctcaaagccttcagatcgcacacaactcgctctgatcagacaaatcgcgatagaatcttgcaggtgatcataagagcggggcaccatgttgatgctatacagtttatgtatgatcatgcgaattcaaatgctctgactccagggattattgcgggaaactccgcaggagggaataggcatgaggtcaatgtgagggatccgcccatgcaggaattgcgcatggagttcgctcatgatgtgcttgcttcgttgcaaattcatttcgagggtggtacatcaacacggagatttggcaatgaacttggttgggcgtctagtatactaacttgtacagccccctatggctacaggttcagctcatttgcctttcgtgaagataccggcccctaccgaacaaccgccatcagtgtactccgcttccaattcacccccgagctggatattcccttgccagcgcaatatattata

SEQ ID NO: 165 - DNA, 1581 bp, Adiantum aethiopicum
atggcagctgaggaagctaaatatgctggatctgaggttgctactactcccgctgctgaggaggtgcagaagaacgacctggcaccaagtgctgtagacatgcaggaggccgaggaggaccccatttttgcgcaattaaagcgggagatgcaggcagctgcagctgtgaaggggcaggagcttcccgtggtagacctgatagacaaatacatgcaagtgcaggctcacgactggcataaccggattagaggcgccatcttagggctgatatccttagtgccggttgtcggtagaggggtcagcaagcttgtcggcctcttttggccaaccaccaaggtagacatttgggaggccctcaagatggagcaatatatccggaacattgtccagcaggagatttttgaatttgaaatgcgtctgcttcagtccgacatcgcagcgctggaaacaactgttgggagatacgatagggctacgtctcttattgagaagggcaattttttgagtatctggatcacacaagctgatgcattatattttcgtatgcgagactctaccaacaacatccaccttctccttcacattgtcaccgtgtctacgcttcacatcgcagccctacatgagcgattgacatttggcgaggaactctatggtacaaacaatgcggcaaattggacgcgagatcttgtggataagttcagactgtacacagttgatttgctcccaagcatttttcggaggtggaaggtatggagggaagcccagattgagattagagcatggatagactggggctcctgtggcaatctttcttgtagaccaaatgtttctcatgcaaccgtacgcgacaaagtctcaggggtggtattggcattccgggcacaaaaccgagcttcgacaacaatattctcaggcctttgtgaaggtcacaaaactcggatgcagaacgaggctgttgccgacatggccagctgcctttcacccacgtttgcttttcacaagctcctacccgacaacattcaggcgcagttttctgcattcgacagggagcagttcgggcaggttttcagaggtccatattcgcaggatctttcgtatgaagcattgacgatgaatgttctgaaatccttcataacgagtccgacgaccttcgatcacacagtgggcagagttttggaggtgaacataagatcagggcaccatgtcgatgctatacggttttggtacggccatttggattcaaattctatgactccaggaatcatgggtggaaactctgggggagggactagccatcaggttgatgtgaggggtcgcctcatacaggatttgcgcatggagttctctcacgacatacttgctgcattgcaactgcatttccaagatggcacatttacacggaaatttggcaacgagcttggctgggcatctcgagtattaacttgtactgctccttatggttacaggctcagctcatgggctttccgccaagatgaaggcccctaccgaacggccgccatcagcgtgctccgcttccagttcactcccgagctggattttcccgtgccagaagaatacatg

SEQ ID NO: 166 - DNA, 1581 bp, Adiantum aethiopicum
atggcagctgaggaagctaaatatgctggatctgaggttgctactactcccgctgctgaggaggtgcagaagaacgacctggcaccaagtgctgtagacatgcaggaggccgaggaggaccccatttttgcgcaattaaagcgggagatgcaggcagctgcagctgtgaaggggcaggagcttcccgtggtagacctgatagacaaatacatgcaagtgcaggctcacgactggcataaccggattagaggcgccatcttagggctgatatccttagtgccggttgtcggtagaggggtcagcaagcttgtcggcctcttttggccaaccaccaaggtagacatttgggaggccctcaagatggagcaatatatccggaacattgtccagcaggagatttttgaatttgaaatgcgtctgcttcagtccgacatcgcagcgctggaaacaactgttgggagatacgatagggctacgtctcttattgagaagggcaattttttgagtatctggatcacacaagctgatgcattatattttcgtatgcgagactctaccaacaacatccaccttctccttcacattgtcaccgtgtctacgcttcacatcgcagccctacatgagcgattgacatttggcgaggaactctatggtacaaacaatgcggcaaattggacgcgagatcttgtggataagttcagactgtacacagttgatttgctcccaagcatttttcggaggtggaaggtatggagggaagcccagattgagattagagcatggatagactggggctcctgtggcaatctttcttgtagaccaaatgtttctcatgcaaccgtacgcgacaaagtctcaggggtggtattggcattccgggcacaaaaccgagcttcgacaacaatattctcaggcctttgtgaaggtcacaaaactcggatgcagaacgaggctgttgccgacatggccagctgcctttcacccacgtttgcttttcacaagctcctacccgacaacattcaggcgcagttttctgcattcgacagggagcagttcgggcaggttttcagaggtccatattcgcaggatctttcgtatgaagcattgacgatgaatgttctgaaatccttcataacgagtccgacgaccttcgatcacacagtgggcagagttttggaggtgaacataagatcagggcaccatgtcgatgctatacggttttggtacggccatttggattcaaattctatgactccaggaatcatgggtggaaactctgggggagggactagccatcaggttgatgtgaggggtcgcctcatacaggatttgcgcatggagttctctcacgacatacttgctgcattgcaactgcatttccaagatggcacatctacacggaaatttggcaacgagcttggctgggcatctcgagtattaacttgtactgctccttatggttacagcctcagctcatggggtttccgccaagatgaaggcccctaccgaacggccgccatcagcgtgctccgcttccagttcgctcccgacctggattttcccgtgccagaagaatacatg

SEQ ID NO: 167 - DNA, 1563 bp, Lygodium flexuosum
atggcagcgcctggcctgatgagctcagctgtaacgatcgctgatggtgttcacgataatgtctctgcgcctgccgccactgagggtgtgcccgacgttgtcgtcgaagatcatggcatcaagattctttctgcgtctgctgaggcggaggtggaagagacagacgttgtcgtagagcagccgcagccagtgctgcagcttcccgactactacattcaagtgaacgctgacgactggcataaccggattaggagtgccatcctgcagttggcatccggaatccccgtagtgggtaacgccgtgagtattctcctcggcctcttttggccagcgaacagggtgaacattttcgagtccatcgagctggagcaatacatcaggaacatcgtcaagcaggagatctttgaatttgagcttcggcaacacatgtcggacatcgaggcgctggaagacactgtcaggagttacgatcgggctgcgctgagggagaaggggaattttctgactgcctggatcacgcaatctaacatcttggctacacggttacggaactctcagaacaacatccacctcctcctccacattgtcaccgtggccacgctccatatggcggccctccatgagcggttcacgtttggcaaggaactctacgcagaagacaatacaacgaattggcaggaggaccttgtggctgcgttccggaggtatgcatatgaagtactcccagttatcttcagacagtggaagtcatggagggaaagccaggttcagattgagacctggactagaaatgcccagcatggagtcattaactatcgtcctgcctcttctcatgccacagtggaggataggcactcaggggagagattcgtgtttaggcgagatggtatacggtcgacaaccatcttcttaccggtctgtgaggaccacaggactcggatggggaatgaggccgttgcagacatggccagctacatatcacccacatttgcgtttcacaagctcctacctgatgatgtccagaggctgctccatgcatatgatgagcagcagtttggtcgggttttcagaggtccctattcccgagaccttctatggaacaacgtctccagctcatctgccatagacttcagatcaagtacaaaccgcaatgattttgttacgagtcgacacggagtcgtcgaggtaaatatacgagcagggcaccatgtcgacgccatccagtttcgctatggtgccgcgaactcggggaatgtgctgggcgttatggcgggaaacaatcgaggcggtaccctcaggcagttcgatgtgaggcaccgggccatagaatcggtgcgcatggagttcgcgcagaacatacttgctgccatccaactcgattttgacgatggcaccaccacacggaggctcggcaatcagctggattggccgacctgggtggcgacttgtaccaccccttttggctacacgctcagctcgtgggcctaccgccaagataacggcccctacggaacagccgcccccagcgtgctccgcttccaatatgcccccccgatagaaccc

SEQ ID NO: 168 - DNA, 1323 bp, Lygodium flexuosum
atggctgtcgtcgctagtgactggaataaccggattagagacgctgttatcaagatctcatccaaaatcccggaagtgggtagtgttgtgagcatcctcatcggcaccttctggccacaagacaaactagacatttttcaggccctcaaggccgacgtgacaaagctcgtgaagcaagagattcttgaacacgagctgaaccagcgtcagtccgagatcgacgcgctaaaagttctaattgcgagataccatgcggctaaggctcatgagaagggtaatttcctaagcaactggatcactgaggctgacagattgagcgtcatctttcgacagtcggagaacaacatccatctcatccttcccattatcaccttggctctgcttcatctgacaggcctgcgggagagattgtactttggcaaggaactctattatgaagacaatacaaaacagtggaaggaggacctcgaggacatgtacaagacatacattgtggattttctcccagatgtcttcagaaggtggaaactgtggagggcagaacaggtgcagattaaatcatgggttgaacggtatccaatggcgatgctgccccagtctcatgccacagttgcggatgctatgacaggcgactggaggcatttctccgtggatttgacagactcaaagacaaatgtgtttcctgaaatatgtgaagaccataagactcggatctgcaacgatgccagtatagacttggcggactgcatctcaaccacgtttgtgtttctcaagctcttacccgacaacagcaagaatttccccgagtatgacaaggaggtgttcggtcggatgttcaaaggcccatattcccaagatcttttcccgacggatcaaagcttcggattcggaaacccagaaccaatttttagaacgcatccagatcatgacgattacaaagccggttcgggcccgatcaccaaggtggtcataagagagtggaacactatcgatgccatgcagtttatctatgcgaatcgtcaaggggttctcgctggtaacagggatggtggagaacggcacgagattgatgtggcagacaagcccataaacggactccgcatggggttctctaacggactgctcacttatgtccaaatcctattttgtgacggtacgtcatcgtctacacatgggaaccgcagtggttggaaatgtgatgaagtatcgccaaaaggcccctctgcctacaaggtcagttcttggagctgtagagtagatgacggcccttcgaactcgtatggccctagtgtaatccagttggaatatgcaccgcagatggaa

SEQ ID NO: 169 - DNA, 1323 bp, Lygodium flexuosum
atggctgtcgtcgctagtgactggaataaccggattagagacgctgttatcaagatctcatccaaaatcccggaagtgggtagtgttgtgagcatcctcatcggcaccttctggccacaagacaaactagacatttttcaggccctcaaggccgacgtgacaaagctcgtgaagcaagagattcttgaacacgagctgaaccagcgtcagtccgagatcgacgcgctaaaagttctaattgcgagataccatgcggctaaggctcatgagaagggtaatttcctaagcaactggatcactgaggctgacagattgagcgtcatctttcgacagtcggagaacaacatccatctcatccttcccattatcaccttggctctgcttcatctgacaggcctgcgggagagattgtactttggcaaggaactctattatgaagacaatacaaaacagtggaaggaggacctcgaggacatgtacaagacatacattgtggattttctcccagatgtcttcagaaggtggaaactgtggagggcagaacaggtgcagattaaatcatgggttgaacggtatccaatggcgatgctgccccagtctcatgccacagttgcggatgctatgacaggcgactggaggcatttctccgtggatttgacagactcaaagacaaatgtgtttcctgaaatatgtgaagaccataagactcggatctgcaacgatgccagtatagacttggcggactgcatctcaaccacgtttgtgtttctcaagctcttacccgacaacagcaagaatttccccgagtatgacaaggaggtgttcggtcggatgttcaaaggcccatattcccaagatcttttcccgacggatcaaagcttcggattcggaaacccagaaccaatttttagaacgcatccagatcatgacgattacaaagccggttcgggcccgatcaccaaggtggtcataagagagtggaacactatcgatgccatgcagtttatctatgcgaatcgtcaaggggttctcgctggtaacagggatggtggagaacggcacgagattgatgtggcagacaagcccataaacggactccgcatggggttctctaacggactgctcacttatgtccaaatcctattttgtgacggtacgtcatcgtctacatatgggaaccgcagtggttggaaatgtgatgaagtatcgccaaaaggcccctctgcctacaaggtcagttcttggagctgtagagtagatgacggcccttcgaactcgtatggccctagtgtaatccagttggaatatgcaccgcagatggaa

SEQ ID NO: 170 - DNA, 1323 bp, Lygodium flexuosum
atggctgtcgtcgctagtgactggaataaccggattagagacgctgttatcaagatctcatccaaaatcccggaagtgggtagtgttgtgagcatcctcatcggcaccttctggccacaagacaaactagacatttttcaggccctcaaggccgacgtgacaaagctcgtgaagcaagagattcttgaacacgagctgaaccagcgtcagtccgagatcgacgcgctaaaagttctaattgcgagataccatgcggctaaggctcatgagaagggtaatttcctaagcaactggatcactgaggctgacagattgagcgtcatctttcgacagtcggagaacaacatccatctcatccttcccattatcaccttggctctgcttcatctgacaggcctgcgggagagattgtactttggcaaggaactctattatgaagacaatacaaaacagtggaaggaggacctcgaggacatgtacaagacatacattgtggattttctcccagatgtcttcagaaggtggaaactgtggagggcagaacaggtgcagattaaatcatgggttgaacggtatccaatggcgatgctgccccagtctcatgccacagttgcggatgctatgacaggcgactggaggcatttctccgtggatttgacagactcaaagacaaatgtgtttcctgaaatatgtgaagaccataagactcggatctgcaacgatgccagtatagacttggcggactgcatctcaaccacgtttgtgtttctcaagctcttacccgacaacagcaagaatttccccgagtatgacaagcaggtgttcggtcggatgttcaaaggcccatattcccaagatcttttcccgacggatcaaagcttcggattcggaaacccagaaccaatttttagaacgcatccagatcatgacgattacaaagccggttcgggcccgatcaccaaggtggtcataagagagtggaacactatcgatgccatgcagtttatctatgcgaatcgtcaaggggttctcgctggtaacagggatggtggagaacggcacgagattgatgtggcagacaagcccataaacggactccgcatggggttctctaacggactgctcacttatgtccaaatcctattttgtgacggtacgtcatcgtctacatatgggaaccgcagtggttggaaatgtgatgaagtatcgccaaaaggcccctctgcctacaaggtcagttcttggagctgtagagtagatgacggcccttcgaactcgtatggccctagtgtaatccagttggaatatgcaccgcagatggaa

SEQ ID NO: 171 - DNA, 1341 bp, Pteris albolineata
atggtgggtgtggatgtcaatgcaagtgactggaacaatcggattagagatgccgttatgaagttgtcagccaaaatcccggaagtgggtgctgttgtaagcactctcataggcttcctctggccacaaaacaaggtcgacatttttcaggccctcaaggcagacgtgataaagctcgtcaagaaagagattcttgactatgaactgaacctgcatgagtctgagattgatgcgctaaaaatcaccattgagagatacaaggcggctaagactaatgagaaggcttattttctcaataactgggtcactgagtctgacaaattaagtgtcatctttcgagagtcgaccaacaacatccaccttatccttcctgttatcaccctggctctgcttcatctcacaggcctgcgggagagactggactatggcaaggaactctatcacgaagacaatacaaaacagtggaaggaggatcttgaggagatgtataagacatacattgtgaactttctccctgatatcttcaagaagtggaaagtatggagggcacagcaggtggagatcaaggcatggacggaaccacatccaacagcaattccccccttctttcggattgagtctcatgcaactgttgtggataccatgacaggtgagaggaagcatttctctgcagatctgacagaatcaacgacaatttttgcaagcgtctgtgaagaccataaaactcgcatgtgcaatgatgccactgctgacatggccggctgcatatcgaccacgttcttgtttgacaagatcttacctgacaacaagaagaatttgcccaagtatgacaagggcgtgttcggtcgaatgtttaaaggtccatattcccaagatttgttattgtcagaccagaattttggctttggcaacccagttaaaactttcagaacacgcccaaatcaggacgactactcgccaagctcgggcccaatcaccaaggtgatcataagagagtggaacactattgatgctatgcactttatctatgcgaaccgtcaagggcatctagccggtaatgctcaaggaggacagaggcatgacatcgatgtgacgggcaagcctataagtggatttcgcatgggattctctaacggattgctcacttttatccaagtcctttactatgatggcacatcatcatcaacatatgggaaccgtagtggttggagatgttatgaagcatctgcaaagggcccctctgcttacagggtcagttcctggagctataaagtagatcgcggcccttcagacacatctggccctagtgtagtccagctggaatacgccccgcagattgaa

SEQ ID NO: 172 - DNA, 1341 bp, Pteris albolineata
atggtgggtgtggatgtcaatgcaagtgactggaacaatcggattagagatgccgttatgaagttgtcagccaaaatcccggaagtgggtgctgttgtaagcactctcataggcttcctgtggccacaaaacaaggttgacatttttcaggccctcaaggcagacgtgataaagctcgtcaagaaagagattcttgactatgaactgaacctgcatgagtctgagattgatgcgctaaaaatcaccattgagagatacaaggcggctaagcctaatgagaaggcttattttctcaataactgggtcactgagtctgacaaattaagtgtcatctttcgagagtcgaccaacaacatccacctcatccttcctgttatcaccctggctctgcttcatctcacaggcctgcgggagagactggactatggcaaggaactctatcacgaagacaatacaaaacagtggaaggaggatcttgaggagatgtataagacatacattgtgaactttctccctgatatcttcaagaagtggaaagtatggagggcagagcaggtggagatcaaggcatggacagaaccacacccaacagcaattccccccttctttcggattgagtctcatgcaactgttgtggataccatgacaggtgagaggaagcatttctctgcagatctgacagattcaatgacaatttttgcaagcatctgtgaagaccacaaaactcgcatgtgcaatgatgccactgctgacatggccggctgcatatcgaccacgttcttgtttgacaagatcttacctgacaacaagaagaatttgcccaagtatgacaagggcgtgttcggtcgaatgtttaaaggtccatattctgaagatttgttattgtcagaccagaattttggcttgggctacccagttaaaattttcagggcacgcccaaatcaggatgactactcgccaagctcgggcccaatcaccaaggtgatcataagagagtggaacactattgatgctatgcactttatctatgcgaaccgtcaagggcatctagccggtaatgctcaaggaggacagaggcatgacatcgatgtgacgggcaagcctataagtggatttcgcatgggattctctaacggattgctcacttttatccaagtcctttactatgatggtacattatcatcaacatatgggaaccgtagtggttggagatgttatgaagcatctgcaaagggcccctctgcttacaccctcagttcctggagctataaagtagatcgcggcccttcagacacatatggccctagtgtagtccagctggaatacgccccgcagattgaa

SEQ ID NO: 173 - DNA, 1341 bp, Pteris albolineata
atggtgggtgtggatgtcaatgcaagtgactggaacaatcggattagagatgccgttatgaagttgtcagccaaaatcccggaagtgggtgctgttgtaagcactctcataggcttcctctggccacaaaacaaggttgacatttttcaggccctcaaggcagacgtgataaagctcgtcaagaaagagattcttgactatgaactgaacctgcatgagtctgagattgatgcgctaaaaatcaccattgagagatacaaggcggctaagcctaatgagaaggcttattttctcaataactgggtcactgagtctgacaaattaagtgtcatctttcgagagtcgaccaacaacatccacctcatccttcctgttatcaccctggctctgcttcatctcacaggcctgcgggagagactggactatggcaaggaactctatcacgaagacaatacaaaacagtggaaggaggatcttgaggagatgtataagacatacattgtgaactttctccctgatatcttcaagaagtggaaagtatggagggcagagcaggtggagatcaaggcatggacggaaccacatccaacagcaattccccccttctttcggattgagtctcatgcaactgttgtggataccatgacaggtgagaggaagcatttctctgcagatctgacagaatcaacgacaatttttgcaagcgtctgtgaagaccataaaactcgcatgtgcaatgatgccactgctgacatggccggctgtatatcgaccacgttcttgtttggcaagatcttgcctgacaacaagaagaatttgcccaagtatgacaagggcgtgttcggtcgaatgtttaaaggtccatattcccaagatttgttattgtcagaccagaattttggcttgggcaacccagttaaaactttcagaacacgcccaaatcaggacgactactcgccaagctcgggcccaatcaccaaggtgatcataagagagtggaacactattgatgctatgcactttatctatgcgaaccgtcaagggcatctagccggtaatgctcaaggaggacagaggcatgacatcgatgtgacgggcaagcctataagtggatttcgcatgggattctctaacggattgctcacttttatccaagtcctttactatgatggtacattatcatcaacatatgggaaccgtagtggttggagatgttatgaagcatctgcaaagggcccctctgcttacaccctcagttcctggagctataaagtagatcgcggcccttcagacacatatggccctagtgtagtccagctggaatacgccccgcagattgaa

SEQ ID NO: 174 - DNA, 1341 bp, Pteris albolineata
atggtgggtgtggatgtcaatgcaagtgactggaacaatcggattagagatgccgttatgaagttgtcagccaaaatcccggaagtgggtgctgttgtaagcactctcataggctttctctggccacaaaacaaggtcgacatttttcaggccctcaaggcagacgtgataaagctcgtcaagaaagagattcttgactatgaactgaacctgcatgagtctgagattaatgcgctaaaaatcaccattgagagatacaaggcggctaagactaatgagaaggcttattttctcaataactgggtcactgagtctgacaaattaagtgtcatctttcgagagtcgaccaacaacatccacctcatccttcctgttatcaccttggctctgcttcatctcacaggcctgcgggagagactggactatggcaaggaactctatcacgaagacaatacaaaacagtggaaggaggatcttgaggagatgtataagacatacattgtgaactttctccctgatatcttcaagaagtggaaagtatggagggcacagcaggtggagatcaaggcatggacggaaccacatccaacagcaattccccccttctttcggattgagtctcatgcaactgttgtggataccatgacaggtgagaggaagcatttctctgcagatctgacagaatcaacgacaatttttgcaagcgtctgtgaagaccataaaactcgcatgtgcaatgatgccactgctgacatggccggctgcatatcgaccacgttcttgtttgacaagatcttacctgacaacaagaagaatttgcccaagtatgacaagggcgtgttcggtcgaatgtttaaaggtccatattcccaagatttgttattgtcagaccagaattttggcttgggctacccagttaaaactttcagaacacgcccaaatcaggacgactactcgccaagctcgggcccaatcaccaaggtaatcataagagagtggaacacgattgatgctatgcactttatctatgcgaaccgtcaagggcatctagccggtaatgctcaaggaggacagaggcatgacatcgatgtgacgggcaagcctataagtggatttcacatgggattctctaacggattgctcacttttatccaagtcctttactatgatggtacatcatcatcaacatatgggaaccgtagtggttggagatgttctgaagcatctgcaaagggcccctctgcctatagggtcagttcctggagctataaagtagatcgcggcccttcagacacatctggccctagtgtagtccagctggaatacgccccgcagattgaa

SEQ ID NO: 175 - DNA, 1320 bp, Adiantum polyphyllum
atggctatcgttgctagtgactggaataaccggattagagacgttgttatgaagctctcatccaaaattccagaagtgggcactgttgtcaacattttcattggcttcttctggccagaaaataagacggacatttttgaggcactcaaggcagacataacaaaacttgtcaagaaacagattcttgactacgaattgaacctacataagtctgagatcaatgctctaaaaagcatcattgagagatacaagaaggctgccaagaaacatgagaagggaaattttctaagcaattggatcactgaggctgataaattgagtgtcatctttcggcaatccaccaacaacatccacctcatccttctcgttatcacccttgctctacttcatctcgcgggcttgcgagagagattggactttggcaaggaaatctatgaggaagacaatacaaaacagtggaaggaggatcttgaggccatgtataagacatacattgtggactttctcccagatatctttcaaaagtggaaagtgtggcgagcaaaccaagtggagattaaagcatggaccaaaatgagtcgaccactattgtatgactcttatgcgactgtcgaggatactattacaggtgaaaagaagtctttcttcgtgggcgagcacaattcaacgacaacgtttgcaaacatctgccaagaccataaaacccgaatgtgcaatgacgccaatgcggacatggccggatgcatatcaaccacatttgtctttgacaagatcttacctgataacaagaagaatttgcccaagtatgacaagaacgtgttcggtcggatgtttagaggtccatattccgaggatcttttctatccggatcgaaaatttaatttctatagggatattccaatatttagatcacgtccaaaccatgatgactatgcatccaactcaggtgcaataactaaggtgatcataagagagtggaacactgttgatgcaatgcaatttatatatgcgaaccgtcaaggttctgtcgctggtaatcctaaagggggacatatgaatgagattaatgtgatgggcaagcccataagtggacttcgcatggggttctctaatggattgctcacttatgcccaaatcatctattgtgatggtacatcaacatctacatatgggaatcgcggtggttggcgatgtgttgaagcatctccaaaagcccccactgcctacaaggtcagttcatggagctataaggaagatcgtggcccttcaagaacatatggtcctagtgtagtccaactggaatatgtaccacaaatagaa

SEQ ID NO: 176 - DNA, 1317 bp, Adiantum polyphyllum
atggctatcgttgctagtgactggaataaccggattagagacgttgttatgaagctctcatccaaaatcccagaagtgggcactgttgtcaacattttcattggcttcttctggccagaaaataagacggacatttttgaggcactcaaggcagacataacaaaacttgtcaagaaacagattcttgagtacgaattgaacctgcataagtctgagatcaatgctctcaaaatcatcattcagagatacaaggctgccaagatacatgagaagggtaattttctaagcaattggatcactgaggctgataaattgagtgtcatctttcggcaatccaccaacaacatccacctcatccttctcgttatcacccttgctctacttcatctcgcgggcttgcgagagagattggactttggcaaggaaatgtatcaggaagacaatacaaaacagtggaaggaggatcttgaggccatgtataagacatacattgtggactttctcccagatatcttcaaaaagtggaaagtgtggcgagcaaaccaagtggagattaaagcgtggaccaaaatgagtcgaccactattgtatgactcttatgcgacggtcgaggatactattacaggtgaaaagaagtctttcttcgtgggcgagcacaattcgacgacaacttttgcaaacatctgccaagaccataaaacccgaatgtgcaatgacgccaatgcggacatggccggatgcatatcaaccacatttgtctttgacaagatcttacctgataacaagaagaatttgcccaagtatgacaagaatgtgttcggtaggatgtttagaggtccatattccgaggatctttactatccggatcgaaaatttaatttctatagggatgttccaatatttagatcacgtccaaaccatgatgactatgcatccaactcaggtgcaataactaaggtgatcataagagagtggaacactgttgatgcaatgcaatttatatatgtgaaccgtcaaggttttgtggctggtaatcctaaagggggacatatgaatgagattaatgtgatgggcaagcccataagtggacttcgcatggggttctctaatggattgctcacttatgcccaaatcatctattgtgatggcacatcaacatctacatatgggaatcgcggtggttggcgatgtgttgaagcatctccaaaagcccccactgcctacaagctcagttcatggagctataaggaagatcgtggcccttcaagaacatatggccctagtgtagtccaattggaatatgtaccacaaatagaa

SEQ ID NO: 177 - DNA, 1320 bp, Adiantum polyphyllum
atggctatcgttgctagtgactggaataaccggattagagacgttgttatgaagctctcatccaaaattccagaagtgggcactgttgtcaacattttcattggcttcttctggccagaaaataagacggacatttttgaggcactcaaggcagacataacaaaacttgtcaagaaacagattcttgactacgaattgaacctacataagtctgagatcaatgctctaaaaagcatcattgagagatacaataaggctgccaagaaacatgagaagggaaattttctaagcaattggatcactgaggctgataaattgagtgtcatctttcggcaatccaccaacaacatccacctcatccttctcgttatcacccttgctctacttcatctcgcgggcttgcgagagagattggactttggcaaggaaatctatgaggaagacaatacaaaacagtggaaggaggatcttgaggccatgtataagacatacattgtggactttctcccagatatctttcaaaagtggaaagtgtggcgagcaaaccaagtggagattaaagcatggaccaaaatgagtcgaccactattgtatgactcttatgcgactgtcgaggatactattacaggtgaaaagaagtctttcttcgtgggcgagcacaattcaacgacaacgtttgcaaacatctgccaagaccataaaacccgaatgtgcaatgacgccaatgcggacatggccggatgcatatcaaccacatttgtctttgacaagatcttacctgataacaagaagaatttgcccaagtatgacaagaacgtgttcggtcggatgtttagaggtccatattccgaggatcttttctatccggatcgaaaatttaatttctatagggatattccaatatttagatcacgtccaaaccatgatgactatgcatccaactcaggtgcaataactaaggtgatcataagagagtggaacactgttgatgcaatgcaatttatatatgcgaaccgtcaaggttctgtcgctggtaatcctaaagggggacatatgaatgagattaatgtgatgggcaagcccataagtggacttcgcatggggttctctaatggattgctcacttatgcccaaatcatctattgtgatggtacatcaacatctacatatgggaatcgcggtggttggcgatgtgttgaagcatctccaaaagcccccactgcctacaaggtcagttcatggagctataaggaagatcgtggcccttcaagaacatatggtcctagtgtagtccaactggaatatgtaccacaaatagaa

SEQ ID NO: 178 - DNA, 1599 bp, Blechnum occidentale
atggcagcgcccggcgtcaaggctgaggacgttacagcgtcaccagctgagcctgaggagaatgtgcatgaggtgaagctagcaacgacaacggacatggaggaggggggtggtccccttcatggggagaaagcgggtggagtgtcatccagccatcaacatcacgaggcggggagcctggatgatgctattgtagaggagtttgcccgaaattcgcaaatggaagcccatgactggcataatcggacgcgagatgttgtgctggcgctgatatccataatcccgacagtgggtgctatcgcaagcgtggtcctcggcatcttctggccagcaaacaaggtggacatttgggtggccctcagcctggaggaatatgttagaaacatcgtgaagcaggagattttcgaattcgagatgcggcagcatcagtcctccatcgaggcactggaatccactattcggagatacaatacggctgcccttcctgaaaaggggaattttctaagcatctggatctcgcaagctgacgcgctgtgtattcggttgcggaactctaccaacgacatccaccttctccttcacattgtcaccgtgtctgtgcttcatatggccgccatgcatgagcgactcacatttggcgaggaactctacggcacagacaatacagcaaattggacgcgagaccttgtggaggtgttccagatgtacacatccgatttaatcccaagcctgttcaggaagtggaagcagtggagggagggactgattgagattagatcgtgggtcgtaccgggtcgatggggcaatctggttcagttaccagatgtttctcatgctacagtggaggataagctcacaggggcgattgtcaggttttcagtagcacgacgaaattcaacaacgattttcttagatgtgtgtcaagaccacaaatccaggatggcgaatgaggccgttgcagacatggccagctgcatgtcatctacttttgcttttcgcagcctcctcccggaccgcattcagggccaataccccgcttatgatagagagctgttcggccaagttttcagaggcccatattcacaggatcactgtaggctggtcgtcacggaattcagaacgttcagaacacggccaacccactttgatcaaacagctatagacagagtctcggagctgattgtaatgacggcaatccattttggcaccatgcaattcgtctacttcgacaataactccaggattccagggcttgtggccggaaacgctagtggcggagggcgctggcaacgtcacgttatcgatgtgttggataagcccatacgcgatctgcgactggagttcaataatgaagcccttgcctcgctgcagcttagtttcgaagatggttcatcaacgccaaggctcggcaacttttcgggttcggcggaggaaaaagtgacctgcacagtccctcgcggctacaggctcagctcatgggccttccgcgcagatcctgccattagtgtgctccgcttccaattcacccccgaagagctccgacccagctcacgggtccggccccagtacaccacccctgcactccaccccataataaat

SEQ ID NO: 179 - DNA, 1203 bp, Blechnum medium
atggcagccttggatcacacgaaggactcagaaattatcgctggccgcgccgtcgctactgatcatgatccagctactgttgtttctgaggaggactcggaaacgaagattgctgaagtggcttgtgatccagctactgctggtgatcccgctggggaagtgcatgaactggacaaactggcgctggagtgcggtagcgacggcatcgacttgcttgccaagcgcatgcaagtggacgcccacgactggcataaccggttgagaggcgctgtgctggggctcctatccgatctcccgttgggtggtgccatcagcaccctcgtcggcctcttttggccagcgacccgggtgaacatctgggaggccctgggcatggaggcatatgttaccaacattgtccggaaggagatctttgagttcgaaatgaggcagcacgagtccgacattgaggcgctggaaagaagcattctgagatatgagaggggcttgcttactgagaaggcgactgccctaggcatctggatcgcacaagccgacgcactgtctattcggttgggaaactccaccaacaggattcatcttctcctccatatcgtcaccgtggccgtgctccatatggccgcattgcacgagcgactgacatttggcgaggaaatttacggcgcaaacaatacagcaaattggacaaaagaactcgaagaaacgttccagaggtacacgtccgatcggatcccagttatcctcaagaccttcaggatgcacccaactcgttccgatattatgttgggcactagagtcttgcaggtgaatgtaagagctgggacccttcttgaatcgatacaatttgtgtactatcatccgtcgagtccaaatggaatcccgaattgggggaatattgccggaaacccgagagggggggagagcttcgtcgttgatgtgaggacgcgtcacatacaggatttgcgcttggagttctctcgagatgtgcttgtttcgctgcagatccggttcgaagatggtacgtccacccaaaaattcggcaatgcgaccgggtgggctactagtgcagtaacttgtaccgccccctctggctacacgctcaactcatgggactttcgtgaagacccaggccccaacggtacaactgccatcagcgtcgccggctacggattcacccccgacgatattcgcttgcctcctgca

SEQ ID NO: 180 - DNA, 1350 bp, Gymnocarpium dryopteris
atgcagatgcagaagggtaccgctgttgcggatgtccgtgctagtgactggaataaccggattcgagacgctgttctgaagctctcatccaaaatcccggaagtgggtaccgctgcaagtattctcatcggcttcctctggccagaaaacaagatcgacgtttttcaggccatcaaggcggacgtgattaatctcgtcaagaaagagattcttgcatccgaactgaaccgccatcactctgagatcgatgggctaaaacttgccattcagagatacaaggcggctcagactcatgagaaggcatgctggctaaccagctggatcactaaggctgattcattgagtctcatctttcgacagtcaaccaacaacatccaccttatccttccccttatcaccttggctctgcttcatctcacagggctgcgggagagactcgactttggcaagacactttacaacgaagacaacacaaaacagtggaaggaggatcttgagcagatgtataagacatacattgtggattttctcccagatatcttcaaaaagtggaaggtgtggagggcagaccaggtagagatcaaagcatggacctcaaagcatctgacgacgattccccccttctttctatacgaggctcatgcaacagttgtggataccgttacaggtgagacaaaacgatacttcaaggatgatttaaactcaacgacacatttcgcaagtatctgccaagaccataagactcgaatgtgcaacgatgccactagtgacatggccggtggcatatcaaccacgttcatgtttgataagctcttacctgacaacaacaagaagttccccaagtatgacaagaaggtgtttggtcggatgttcaagggtccatatgccgaaggtcttctccgggaagagaaatatgttcctgatttccgaacacgtccagatcgtgatgattactcacccaactcgggcccaatcaccaaggtgatcataagagagtggaacactatagacgccatgcaatttatctatgccaatcgtcaagggcttgtggctggtaacgcgagtgggggaaagaggcacgacgtggacgtgatgggcaacaagcccataaatggacttcgcatggggttctctaatggactgctcacttatgtccaaatcatgtattgtgatggtacatcatcagatacatatgggaaccgtagcggttggcgatgccaggaggtatctgcaaacggcccctctgcctacaagctcagttcatggagctataaagtgaaccaaggcccttcaggcacatctggccctggcgtcatccagttggaatacacaccacaactcatggccgaa

SEQ ID NO: 181 - DNA, 1350 bp, Gymnocarpium dryopteris
atgcagatgcagaagggtaccgctgttgcggatgtccgtgctagtgactggaataaccggattcgagacgctgttctgaagctctcatccaaaatcccggaagtgggtaccgctgcaagtattctcatcggcttcctctggccagaaaacaagatcgacgtttttcaggccatcaaggcggacgtgattaatctcgtcaagaaagagattcttgcatccgaactgaaccgccatcactctgagatcgatgggctaaaacttgccattcagagatacaaggcggctcagactcatgagaaggcatgctggctaactagctggatcactaaggctgattcattgagtctcatctttcgacagtcaaccaacaacatccaccttatccttccccttatcaccttggctctgcttcatctcacagggctgcgggagagactcgactttggcaagacactttacaacgaagacaacacaaaacagtggaaggaggatcttgagcagatgtataagacatacattgtggattttctcccagatatcttcaaaaagtggaaggtgtggagggcagaccaggtagagatcaaagcatggacctcaaagcatctgacgacgattccccccttctttctatacgaggctcatgcaacagttgtggataccgttacaggtgagacaaaacgatacttcaaggatgatttaaactcaacgacacatttcacaagtatctgccaagaccataagactcgaatgtgtaacgatgccactagtgacatggccggcggcatatcaaccacattcatgtttgacaagctcttacctgacaacaacaagaagttccccaagtatgacaagaaggtgtttggtcggatgttcaagggtccatatgccgaaggtcttctccgggaagagaaatatgttcctgatttccgaacacgtccagatcgtgatgattactcacccaactcgggcccaatcaccaaggtgatcataagagagtggaacactatagacgccatgcaatttatctatgccaatcgtcaagggcttgtggctggtaacgcgagtgggggaaagaggcacgacgtggacgtgatgggcaacaagcccataaatggacttcgcatggggttctctaatggactgctcacttacgtccaaatcatgtattgtgatggtacatcatcagatacatatgggaaccgtagcggttggcgatgccaggaggtatctgcaaacggcccctctgcctacaagctcagttcatggagctataaagtgaaccaaggcccttcaggcacatctggccctggcgtcatccagttggaatacacaccacaactcatggccgaa

SEQ ID NO: 182 - DNA, 1350 bp, Gymnocarpium dryopteris
atgcagatgcagaagggtaccgctgttgcggatgtccgtgctagtgactggaataaccggattcgagacgctgttctgaagctctcatccaaaatcccggaagtgggtaccgctgcaagtattctcatcggcttcctctggccagaaaacaagatcgacgtttttcaggccatcaaggcggacgtgattaatctcgtcaagaaagagattcttgcatccgaactgaaccgccatcactctgagatcgatgggctaaaacttgccattcagagatacaaggcggctcagactcatgagaaggcatgctggctaactagctggatcactaaggctgattcattgagtctcatctttcgacagtcaaccaacaacatccaccttatccttccccttatcaccttggctctgcttcatctcacagggctgcgggagagactcgactttggcaagacactttacaacgaagacaacacaaaacagtggaaggaggatcttgagcagatgtataagacatacattgtggattttctcccagatatcttcaaaaagtggaaggtgtggagggcagaccaggtagagatcaaagcatggacctcaaagcatctgacgacgattccccccttctttctatacgaggctcatgcaacagttgtggataccgttacaggtgagacaaaacgatacttcaaggatgatttaaactcaacgacacatttcacaagtatctgccaagaccataagactcgaatgtgtaacgatgccactagtgacatggccggcggcatatcaaccacattcatgtttgacaagctcttacctgacaacaacaagaagttccccaagtatgacaagaaggtgtttggtcggatgttcaagggtccatatgccgaaggtcttctccgggaagagaaatatgttcctgatttccgaacacgtccagatcgtgatgattactcacccaactcgggcccaatcaccaaggtgatcataagagagtggaacactatagacgccatgcaatttatctatgccaatcgtcaagggcttgtggctggtaacgcgagtgggggaaagaggcacgacgtggacgtgatgggcaacaagcccataaatggatttcgcatggggttctctaatggactgctcacttatgtccaaatcatgtattgtgatggtacatcatcagatacatatgggaaccgtagcggttggcgatgccaggaggtatctgcaaacggcccctctgcctacaagctcagttcatggagctataaagtgaaccaaggcccttcaggcacatctggccctggcgtcatccagttggaatacacaccacaactcatggccgaa

SEQ ID NO: 183 - DNA, 1350 bp, Gymnocarpium dryopteris
atgcagatgcagaagggtaccgctgttgcggatgtccgtgctagtgactggaataaccggattcgagacgctgttctgaagctctcatccaaaatcccggaagtgggtaccgctgcaagtattctcatcggcttcctctggccagaaaacaagatcgacgtttttcaggccatcaaggcggacgtgattaatctcgtcaagaaagagattcttgcatccgaactgaaccgccatcactctgagatcgatgggctaaaacttgccattcagagatacaaggcggctcagactcatgagaaggcatgctggctaactagctggatcactaaggctgattcattgagtctcatctttcgacagtcaaccaacaacatccaccttatccttccccttatcaccttggctctgcttcatctcacagggctgcgggagagactcgactttggcaagacactttacaacgaagacaacacaaaacagtggaaggaggatcttgagcagatgtataagacatacattgtggattttctcccagatatcttcaaaaagtggaaggtgtggagggcagaccaggtagagatcaaagcatggacctcaaagcatctgacgacgattccccccttctttctatacgaggctcatgcaacagttgtggataccgttacaggtgagacaaaacgatacttcaaggatgatttaaactcaacgacacatttcgcaagtatctgccaagaccataagactcgaatgtgcaacgatgccactagtgacatggccggtggcatatcaaccacgttcatgtttgataagctcttacctgacaacaacaagaagttccccaagtatgacaagaaggtgtttggtcggatgttcaagggtccatatgccgaaggtcttctccgggaagagaaatatgttcctgatttccgaacacgtccagatcgtgatgattactcacccaactcgggcccaatcaccaaggtgatcataagagagtggaacactatagacgccatgcaatttatctatgccaatcgtcaagggcttgtggctggtaacgcgagtgggggaaagaggcacgacgtggacgtgatgggcaacaagcccataaatggacttcgcatggggctctctaatggactgctcacttacgtccaaatcatgtattgtgatggtacatcatcagatacatatgggaaccgtagcggttggcgatgccaggaggtatctgcaaacggcccctctgcctacaagctcagttcatggagctataaagtgaaccaaggcccttcaggcacatctggccctggcgtcatccagttggaatacacaccacaactcatggccgaa

SEQ ID NO: 184 - DNA, 1380 bp, Polystichum acrostichoides
atggactctcaaaaagttgctgtctctggcccgatcactttggtggatgtcgttgctagtgactggaataaccggattagagacactgttatgaagatctcatccaaaatccccgaagtgggtgctgttgtaagcattatcatcggcttcttctggccacaaaacaagatcgacgtttttcaggccctcaaggcggacttgacaaagctcgtcaagaaggagattcttgagttcgaactgaaccaacgtcagtctgagatcgatgcgctaaaacttatcattgagagatacaaggcggctaagaatcatgagaaggcttattttctaaacaactggatcacagaggctgacaaattgagtgtcatctttcgacagtcgaccaacaacatccacctcatccttctcgttatcaacctggctgtgcttcatctcacaggcctgcgggagagactggactttggcaaggaactctatgatgaagacaacacaaaacggtggaaggaggatcttgaggagatgtataaggcatacgttgtggactttcttccagatatcttcaaaaagtggaaagtgtggagggcagaccaggtggagattaaagcatgggtggaaacacatccaacagcaattccccccttctttcggatggagtctcatgcaacagttgtggatactattacaggtgagaggaagcatttctccgtggatctgacagagtcaatggcaatttttgcgagaatctgcgaagaccataagactcggatgtgcaacgatgcctttggtgacatggccggctgcatatcaaccacgttcgtgtttgtcaagctcttacctgacaacaacaagaatttccccaagtatgacaaggaggtgttcggtcggatgttcaaaggtccatattccgaagatctttactggccggatcgaaattttggattgggctacccagttccagttttcagaacgcgtccagatcatcacgactactcgtccaactcgggcccaattaccaaggtgatcataagagagtggaactctattgatgccatgcagtttatctatgcaaaccgacaagggcttctagccggtaacgctcaagggggacagaggcacgacgttgatgtgacgggcaagcccataaatggacttcacatggggtttggtagtggagtgctcgcttctgtccaaatcatttattatgatggtacattatcattatcatctaaatatgggaaccgtagcggttggaaacttcaggaagtatctgcaaacggccccactgcttacagggtcagttcatggagctataaagtagatcagggcccctcaaactcatctggccctagtgtaatccagttggaatacaccccgcagattgaa

SEQ ID NO: 185 - DNA, 1236 bp, Polystichum acrostichoides
atggactctcaaaaagttgctgtctctggcccgatcactttggtggatgtcgttgctagtgactggaataaccggattagagacactgttatgaagatctcatccaaaatccccgaagtgggtgctgttgtaagcattatcatcggcttcttctggccacaaaacaagatcgacgtttttcaggccctcaaggcggacttgacaaagctcgtcaagaaggagattcttgagttcgaactgaaccaacgtcagtctgagatcgatgcgctaaaacttatcattgagagatacaaggcggctaagaatcatgagaaggcttattttctaaacaactggatcacagaggctgacaaattgagtgtcatctttcgacagtcgaccaacaacatccacctcatccttctcgttatcaacctggctgtgcttcatctcacaggcctgcgggagagactggactttggcaaggaactctatgatgaagacaacacaaaacggtggaaggaggatcttgaggagatgtataaggcatacgttgtggactttcttccagatatcttcaaaaagtggaaagtgtggagggcagaccaggtggagattaaagcatgggtggaaacacatccaacagcaattccccccttctttcggatggagtctcatgcaacagttgtggatactattacaggtgagaggaagcatttctccgtggatctgacagagtcaatggcaatttttgcgagaatctgcgaagaccataagactcggatgtgcaacgatgcctttggtgacatggccggctgcatatcaaccacgttcgtgtttgtcaagctcttacctgacaacaacaagaatttccccaagtatgacaaggaggtgatcataagagagtggaactctattgatgccatgcagtttatctatgcaaaccgacaagggcttctagccggtaacgctcaagggggacagaggcacgacgttgatgtgacgggcaagcccataaatggacttcacatggggtttggtagtggagtgctcgcttctgtccaaatcatttattatgatggtacattatcattatcatctaaatatgggaaccgtagcggttggaaacttcaggaagtatctgcaaacggccccactgcttacagggtcagttcatggagctataaagtagatcagggcccctcaaactcatctggccctagtgtaatccagttggaatacaccccgcagattgaa

SEQ ID NO: 186 - DNA, 1380 bp, Polystichum acrostichoides
atggactctcaaaaagttgctgtctctggcccgatcactttggtggatgtcgttgctagtgactggaataaccggattagagacactgttatgaagatctcatccaaaatccccgaagtgggtgctgttgtaagcattatcatcggcttcttctggccacaaaacaagatcgacgtttttcaggccctcaaggcggacttgacaaagctcgtcaagaaggagattcttgagttcgaactgaaccaacgtcagtctgagatcgatgcgctaaaacttatcattgagagatacaaggcggctaagaatcatgagaaggcttattttctaaacaactggatcacagaggctgacaaattgagtgtcatctttcgacagtcgaccaacaacatccacctcatccttctcgttatcaacctggctgtgcttcatctcacaggcctgcgggagagactggactttggcaaggaactctatgatgaagacaacacaaaacggtggaaggaggatcttgaggagatgtataagacatacgttgtggactttcttccagatatcttcaaaaagtggaaagtgtggagggcagaccaggtggagattaaagcatgggtggaaacacatccaacagcaattccccccttctttcggatggagtctcatgcaacagttgtggatactattacaggtgagaggaagcatttctccgtggatctgacagagtcaatggcaatttttgcgagaatctgcgaagaccataagactcggatgtgcaacgatgcctttggtgacatggccggctgcatatcaaccacgttcgtgtttgtcaagctcttacctgacaacaacaagaatttccccaagtatgacaaggaggtgttcggtcggatgttcaaaggtccatattccgaagatctttactggccggatcgaaattttggattgggctacccagttccagttttcagaacgcgtccagatcatcacgactactcgtccaactcgggcccaattaccaaggtgatcataagagagtggaactctattgatgccatgcagtttatctatgcaaaccgacaagggcttctagccggtaacgctcaagggggacagaggcacgacgttgatgtgacgggcaagcccataaatggacttcacatggggtttggtagtggagtgctcgcttctgtccaaatcatttattatgatggtacattatcattatcatctaaatatgggaaccgtagcggttggaaacttcaggaagtatctgcaaacggccccactgcttacagggtcagttcatggagctataaagtagatcagggcccctcaaactcatctggccctagtgtaatccagttggaatacaccccgcagattgaa

SEQ ID NO: 187 - DNA, 1425 bp, Cheilanthes sieberi
atgcttcggtctgcttctaattcatatgtgataatgtctatacagaattcggcctgtcataagattgccctgtcgaagctcaatccggagatggcggatgtcgttgcgagtgactggaacaaccggattcgaggcactgtcatgaggttgtcatccaaagtcccggaagtcggtgctgtcgttagcattctcatcggcttcctctggccagaaaacaaagtcgatgtgttccaggctctcaaggccgacataacaaagcttatcaagaaagagattcttgactacgaactgaacctgcatgcgtctgagattgatgccctgaagatcatcatcgagagatacaaggaggctaagaataatgagaagggttactttctcaactcctggatcactgaggccgacaaattgagtgtcatctttcgacagtccaccaacaacatccacctcatccttccagttatcacccttgctctgcttcacctgacgggcctgcgagaacgactggactttggcagggaactctatcacgaagacaatacaaaacagtggaaggaggatcttgaggacatgtataagacatacattgtgaactttctgcctactatcttcaaaaagtggaaattgtggaggacagaccaggtggagataaaaccatggactgaaacacatccaactgcaattccgcccttcttccggattgaatctcatgcaaccgttgtcgatacaattacaggtgagaggaagcatttctctgcggatctgaccgactcaaaaacaacatttgcaaggatctgtgacgaccataagactcgcatgtgcaatgatgccagttctgacatggctggctgcatatcggccacgttcgtgtatgacaagctcttacctgacaacaagaagaatttacccaagtatgataagggggtgttcggccggatgttcaaaggtccatattccgcagatcttctgctttcggatcggagttttggagtcggcaacccagttccaattttcagaacacgcccagatcaagacgactactcacccagctcaggccaaatcaccaaggttgtcataagagaatggaacagtattgatgccatgtactttatctacgcaaaccgtcaagggcgtatagctggcaacgctagtgggggacaaagacacgacattgacgtaactcgaaagcccataaatggacttcgaatgggattttccaatggagtgcttacatctgtccaaatcttgtattatgatggtacatcatcatccacatacgggaaccgtagtggttggaaatgttatgaaacatttgcaaaaggccccactgcctacagggtcagttcatggagtttcaaagtagatcgaggcccttcaaacacatatggccccagtgtaatccagttggaatatgcccctctcatcgaa

SEQ ID NO: 188 - DNA, 1500 bp, Polypodium vulgare
atggactcagaaatgatcgcagctccgcctgcagctatggacgatcaattagcagcacaagagaagatgactgtgccagctggtgataatgttgagaagctggatcagctgggggtagatgtgcttgccagaaacatgcaaatcgaggctcatgactggcaaaaccggcttagaaggtcgataatgacgctggcatccaagattccgaaggtgggcggtgccgtgagcctgctcattggcctcttttggccagcaaacaaggtggacatttgggaggccatcaatggggaggaatatgtgagaaacattgtccagcaggagatttttgaattcgaattgcagcaactccggtccgacatcgaggcactgcaagccactgtttcaagatacaatatggctgcgttaaccgagaaggggaattttctaagcatctggatcgcgcaagctgacgccctgagtattcgcatgcggaactctagcaacaacatccaccttctccttcaccttgtcaccgtggctgtgcttcatgtcgcagccctccacgagcgacttacatttggcgaggaactctacggctcaaaccatacagcaagttggaagcaagaccttgtgaatttgttccagctgtacacatccgacatagtcccaaagctcttcaaagagtggaggcagtggagggaaagccagattgagattaaagcatgggtagtaagaggcgcatggggaaaccttgtttcaaggccagacgtttctcatgctacagtggaggataagatctcaagggagatgttcacgtttcgggaaacgagacgaaactcgacaacaattttctcagatgtttgccaggatcacaaaactcggatgatgaatgaggccattgcggacatggccagctgcatgtcacccacgtttgcttttcacaagctcttacccgacgatattcagacgcagttccctgcttacgataaggagctcttcgaacaagttttcagaggcccatattcacaggatcttctgcaaaaactctttacgactctcaaagccttcagatcacggccaactcgcgtcgaccagacggctcgcaacagaatcctggaggtggttgtaagagcgggccaccatgttgatgctatacaattttggtatgaccatgtgaattcaaatagtatgactgcagggactatggctggaaaccctacgggggggaataggcatttggttaatgtgaggaatcggcccatacatgaattacggatggagttctctcatgacgtgattgtttcgttgcaacttcgtttcgaagatggtacatctacatcaaaatttggcaatacaattggttgggcatctagtatagtaacttgtacagccccctctggctacaggctcagctcatgggcctttcgtgaagattctggcccctataacacaactgccatcagtgtactccgcttccaattcacccccgaagatccggcctccctcgaggatccctcatca

SEQ ID NO: 189 - DNA, 1551 bp, Adiantum hispidulum
atggcggcgcccggcatgaatataatggactcagttgatgatcccatgcaagaaatgatcgctcataaggacgatgtaattaacagtgactctactgtttctgtcggggaggcacatgagctagtgcaagacaatactgttgttgctgatgctgcactgcatggtgatggtgttgctgataaggagcaagtggacgtagatgtgcttgcccaaaacgtgcggatggaggctcatgactggcacaaccggattagagacgctattctgggccttatttccgaagtccccatggtgggtgctggcataagcacccttatcggcctcttttggccagccaaccaggtggacatttgggaggccatcaatgcggagcaatatattaagaacattgtcaggcaggagatttttgaattcgaattgcaacaacatctgtctgacatcgaggcattgcaagtcactgttttgagatatgagagggctgcgccaaatgagaagggaaattttctaagcatctggatctcgcaagccgacaaattgattattcggatgcgaaattctgcgaacaacatccaccttatccttcacattgtcacggtgtctgtgcttcatgtcgcagccatgcacgagcgcttgatgtttggcgaggaactctatggtccaaaccctactgcaagctgggagaaagaactggtggaagtgttcaagatgtacacattcgatctacttgtgcgtgtcttcgaggattggaagcagtggagggtagagcagattgagatcaaggcatggactgtgaagtcccagtggggcggtattactcaaaataggccagcccggtctcacgcaactgtggaggataagctctcaggggaaattatgaggttccaggtagacaatcaattatcgacaacagttttctccgcaatttgtgaagatcacaaggctcggatgatgaacgaggccgttgcggacatggccagttgcatctcccccacgtttgggtttcacaagctcctaccgcccgctattcagagacagcaccctgcgtatggtgcagtattcacgacagttttcagaggcccgtattccctggatcttttgataaggaactctacaaggcaaacatccttcagatcgcgtacaactcgcgatgatatcttgccgaggagtgacgaaacaatcttggaggtgttcataagatcggggactcatattgatgccatacaatttttgtacggtgtcactccaaacatgacgaggccagggattatggccggaaatagtgtgggggggcatagcaataaggttgatgtgaggggtcggcccatacaccaactgcacatggagttctctcgtggcgtgcttgcttccttgcgacttggtttccaagatggtacatcaacacagagatatggccttgagcgtggtcaattagcggccacttgcactgccccctctggctacaggttccgttcgtgggcctttcgtgaagatttaggtccctacagttcatccgccatctctgtactccgcttccaattcacccccgacgat

SEQ ID NO: 190 - DNA, 1551 bp, Adiantum hispidulum
atggcggcgcccggcatgaatataatggactcagttgatgatcccatgcaagaaatgatcgctcataaggacgatgtaattaacagtgactctactgtttctgtcggggaggcacatgagctagtgcaagacaatactgttgttgctgatgctgcactgcatggtgatggtgttgctgataaggagcaagtggacgtagatgtgcttgcccaaaacgtgcggatggaggctcatgactggcacaaccggattagagacgctattctgggccttatttccgaagtccccatggtgggtgctggcataagcacccttatcggcctcttttggccagccaaccaggtggacatttgggaggccatcaatgcggagcaatatattaagaacattgtcaggcaggagatttttgaattcgaattgcaacaacatctgtctgacatcgaggcattgcaagtcactgttttgagatatgagagggctgcgccaaatgagaagggaaattttctaagcatctggatctcgcaagccgacaaattgattattcggatgcgaaattctgcgaacaacatccaccttatccttcacattgtcacggtgtctgtgcttcatgtcgcagccatgcacgagcgcttgatgtttggcgaggaactctatggtccaaaccctactgcaagctgggagaaagaactggtggaagtgttcaagatgtacacattcgatctacttgtgcgtgtcttcgaggattggaagcagtggagggtagagcagattgagatcaaggcatggactgtgaagtcccagtggggcggtattactcaaaataggccagcccggtctcacgcaactgtggaggataagctctcaggggaaattatgaggttccaggtagacaatcaattatcgacaacagttttctccgcaatttgtgaagatcacaaggctcggatgatgaacgaggccgttgcggacatggccagttgcatctcccccacgtttgggtttcacaagctcctaccgcccgctattcagagacagcaccctgcgtatggtgcagtattcacgacagttttcagaggcccgtattccctggatcttttgataaggaactctacaaggcaaacatccttcagatcgcgtacaactcgcgatgatatcttgccgaggagtgacgaaacaatcttggaggtgttcataagatcggggactcatattgatgccatacaatttttgtacggtgtcactccaaacatgacgaggccagggattatggccggaaatagtgtgggggggcatagcaataaggttgatgtgaggggtcggcccatacaccaactgcacatggagttctctcgtggcgtgcttgcttccttgcgacttggtttccaagatggtacatcaacacagagatatggccttgagcgtggtcaattagcggccacttgcactgccccctctggctacaggttccgttcgtgggcctttcgtgaagatttaggtccccacagttcatccgccatctctgtactccgcttccaattcacccccgacgat

SEQ ID NO: 191 - DNA, 1545 bp, Colysis ampla
atggcagccttggacatgaaggactcagaaatgatcgctggcgccgtcgctactcctactgttgtttctgaggaggacttggaaacgatcgctgaagtctctactgtaacggttgtttgtgaccccgctggggaagtgcatgagctggataaactagtgctgcagggcggcaacgataacattgacttgcttgctagacacttgcaaatggaggctcacgactggcataaccgcatcagaagcgctgtgctggctctcatgtcggacataccgggcgtgggtggtaccgtaagcttcgtcgtcggcctcttttggccagcgagcaaggtgaacatttgggaggccctcaacgcggaggcatatgtttcgaacattgtccggagggagatttttgagttcgaaatgaggcagcacgaggccgccattcaggcgctggaagggaccattcggagatatgagacgggctcgctttctcagaaggcgattgacctacgcatctggatcgcgcaagccgacgcactgtctcttcggttgggaaactcttccaacaggattcatcttctcctccatattgtcaccgtggccgtgctccatatgaccgccttgcatgagcaactggcatttggcgaggaactttacggcacagacaatacagcgaattggacgaaagaactcgaagaacagttccagcggtacacgtccgagcgaatcccagttatcttcaaggagtggagcccgtggagggaaagccagattgagatcagagcatggaggagacgggcaagcggcatggttatttataatccagacgcttcttttgcggcagtggaggacaagctctcaggggagatcttcaatttcagtgtcggctatcactactcgacaacgattttcttagacatttgtgaagctcacaaagcaaggatgatgaatgaggccattgcagacatggccagttgcatgtcgcccacctttgcttttcacaagctcctacccaacgacagccaaagcaaattctctccttatgataggcagctcttcgggcaagtttttcgagggccatattcacaggatcttctccagccactcttcacgaatctgaaaaccttcagattgcacccaactcgtttcgatcaaacgttccgcaataaaatcttgcaggtgactgtacgagctgggacggttcttgaagcgatgcaattctggtacgatcatgcgagtccaaatgctatgactcaggggattatggccggaaacccaacaggggggtttagattcgacgttgatgtgaggacacgacgcatacaggatttgcgcttggagttctctcgagatgtgctagtttcgctgcagattcggttcgaagatggttcatcgacacaaagattcggcagtgacgccgggtggccttctaacacagtaacttgtacagccccctctggctacaggcttagctcatgggcctttcgtgaagacacaggccccaacaatagaaccgccatcagcatcgtccgcttccgattcacccccgacgatcctttgcca

SEQ ID NO: 192 - DNA, 1545 bp, Colysis ampla
atggcagccttggacatgaaggactcagaaatgatcgctggcgccgtcgctactcctactgttgtttctgaggaggacttggaaacgatcgctgaagtctctactgtaacggttgtttgtgaccccgctggggaagtgcatgagctggataaactagtgctgcagggcggcaacgataacattgacttgcttgctagacacttgcaaatggaggctcacgactggcataaccgcatcagaagcgctgtgctggctctcatgtcggacataccgggcgtgggtggtaccgtaagcttcgtcgtcggcctcttttggccagcgagcaaggtgaacatttgggaggccctcaacgcggaggcatatgtttcgaacattgtccggagggagatttttgagttcgaaatgaggcagcacgaggccgccattcaggcgctggaagggaccattcggagatatgagacgggctcgctttctcagaaggcgattgacctacgcatctggatcgcgcaagccgacgcactgtctcttcggttgggaaactcttccaacaggattcatcttctcctccatattgtcaccgtggccgtgctccatatgaccgccttgcatgagcaactggcatttggcgaggaactttacggcacagacaatacagcgaattggacgaaagaactcgaagaacagttccagcggtacacgtccgagcgaatcccagttatcttcaaggagtggagcccgtggagggaaagccagattgagatcagagcatggaggagacgggcaagcggcatggttatttataatccagacgcttcttttgcggcagtggaggacaagctctcaggggagatcttcaatttcagtgtcggctatcactactcgacaacgattttcttagacatttgtgaagctcacaaagcaaggatgatgaatgaggccattgcagacatgaccagttgcatgtcgcccacctttgcttttcacaagctcctacccaacgacagccaaagcaaattctctccttatgataggcagctcttcgggcaagtttttcgagggccatattcacaggatcttctccagccactcttcacgaatctgaaaaccttcagattgcacccaactcgtttcgatcaaacgttccgcaataaaatcttgcaggtgactgtacgagctgggacggttcttgaagcgatgcaattctggtacgatcatgcgagtccaaatgctatgactcaggggattatggccggaaacccaacaggggggtttagattcgacgttgatgtgaggacacgacgcatacaggatttgcgcttggagttctctcgagatgtgctagtttcgctgcagattcggttcgaagatggttcatcgacacaaagattcggcagtgacgccgggtggccttctaacacagtaacttgtacagccccctctggctacaggcttagctcatgggcctttcgtgaagacacaggccccaacaatagaaccgccatcagcatcgtccgcttccgattcacccccgacgatcctttgcca

SEQ ID NO: 193 - DNA, 1578 bp, Adiantum formosum
atggcagcttccgccacgtcagctgatccgcaactgaagctagttgaggacaacgttaatgtaactactgaagagaagaatgttgaatccgtgattatgacggcgccagactcagatgatgaggcgcaaccagagcaagagtggatgattactgacgtcaacgtcagtattactgctgctgctgccgccgccgccgtgaagctggggctggggaaggaggtagacgtgcttgccaaatacatggaaatcgaggctcatgactggaataatcggattagagaagttgtcatcgggctggcatcctacatacccgtggtgggcgatgccgtaagcatgctcatcggcattttctggccaaccagcaaggtggacatctggcaggccctcaatgcggagcaatatgttcgaaacattgtccaacaggagatttttcaatttgaattgcagctacttcagtccgacatggacacgttgaaaaccactattttgagatacgagggggctgcgcttaatgagaagaggggttttctcaccagctggatcgggctagcagacggattgtgtaatcggatgcgaaactctcgcaacaacatccagcttctccttcacattgtcaccgtctctgtgctccatgtcacggccctgctcgagcgactcaactttggcgaggaaatctacaacgaaaacaataccgcaaggtggaagcaagatcttgtggacttgttcaagatgtacacattcgatatactcccttctatcttcaacgagtggcaggtgtggagggtgaggcagatcgagatcgaggcatggagaagaagggcccaatttggtccagttatgtttacgccggacagttctcatgctacagtggaggataagctctctggggagaaaatcacgtttcgggtaaactaccaatactcaacaacaattttctcagcagtttgtgaagatcacaagactcggatggggaacgaggccgttgccgacatggccagctgcatttcgcccacgtttgggtttcacaagctgctaccggccgatagtcaggcacagttctctccttatgataaaagcgcgttcggccgggtttttaggggcccatactctcaagatcttttgtggcgctccttcataaacgtcaaagacttcagatcgcgtccaactcgctttgaccagacggctcgcgacagagtccttgagatggtgataagagcagggcaccatgttgatgctatacaattttggtataatcacgcgaatgcaaatgctatgactgcagggacaatggctggaaacccttggggggggaatagatttcaagttgatgtgagaggtcggcccatacaagacttgcgcatggagtttgctaatgacgtgcttgcttccttgcaacttcgtttcaaagatggtacggcaacacaaagatttggcaacacacagggttgggcgtctaatgtagtgacttgtacaacccccgctggctacaggctcagctcatgggcctttcgtgaagatcccggcccctaccacacacaagccatcagtttactccgctttcaattcacccccgaggat

SEQ ID NO: 194 - DNA, 1578 bp, Adiantum formosum
atggcagcttccgccacgtcagctgatccgcaactgaagctagttgaggacaacgttaatgtaactactgaagagaagaatgttgaatccgtgattatgacggcgccagactcagatgatgaggcgcaaccagagcaagagtggatgattactgacgtcaacgtcagtattactgctgctgctgccgccgccgccgtgaagctggggctggggaaggaggtagacgtgcttgccaaatacatggaaatcgaggctcatgactggaataatcggattagagaagttgtcatcgggctggcatcctacatacccgtggtgggcgatgccgtaagcatgctcatcggcattttctggccaaccagcaaggtggacatctggcaggccctcaatgcggagcaatatgttcgaaacattgtccaacaggagatttttcaatttgaattgcagctacttcagtccgacatggacacgttgaaaaccactattttgagatacgagggggctgcgcttaatgagaagaggggttttctcaccagctggatcgggctagcagacggattgtgtaatcggatgcgaaactctcgcaacaacatccagcttctccttcacattgtcaccgtctctgtgctccatgtcacggccctgctcgagcgactgaagtttggcgaggaaatctacaacgaaaacaataccgcaaggtggaagcaagatcttgtggacttgttcaagatgtacacattcgatatactccctcctatcttcaacgagtggcaggtgtggagggtgaggcagatcgagatcgaggcatggagaagaagggcccaatttggtccagttatgtttacgccggacagttctcatgctacagtggaggataagctctctggggagaaaatcacgtttcgggtaaactaccaatactcaacaacaattttctcagcagtttgtgaagatcacaagactcggatggggaacgaggccgttgccgacatggccagctgcatttcgcccacgtttgggtttcacaagctgctaccggccgatagtcaggcacagttctctccttatgataaaagcgcgttcggccgggtttttaggggcccatactctcaagatcttttgtggcgctccttcataaacgtcaaagacttcagatcgcgtccaactcgctttgaccagacggctcgcgacagagtccttgagatggtgataagagcagggcaccatgttgatgctatacaattttggtataatcacgcgaatgcaaatgctatgactgcagggacaatggctggaaacccttggggggggaatagatttcaagttgatgtgagaggtcggcccatacaagacttgcgcatggagtttgctaatgacgtgcttgcttccttgcaacttcgtttcaaagatggtacggcaacacaaagatttggcaacacacagggttgggcgtctaatgtagtgacttgtacaacccccgctggctacaggctcagctcatgggcctttcgtgaagatcccggcccctaccacacacaagccatcagtttactccgctttcaattcacccccgaggat

SEQ ID NO: 195 - DNA, 1581 bp, Adiantum formosum
atggcagcttccgccacgtcagctgatccgcaactgaagctagttgaggacaacgttaatgtaactactgaagagaagcagaatgttgaatccgtgattatgacggcgccagactcagatgatgaggcgcaaccagagcaagagtggatgattactgacgtcaacgtcagtattactgctgctgctgccgccgccgccgtgaagctggggctggggaaggaggtagacgtgcttgccaaatacatggaaatcgaggctcatgactggaataatcggattagagaagttgtcatcgggctggcatcctacatacccgtggtgggcgatgccgtaagcatgctcatcggcattttctggccaaccagcaaggtggacatctggcaggccctcaatgcggagcaatatgttcgaaacattgtccaacaggagatttttcaatttgaattgcagctacttcagtccgacatggacacgttgaaaaccactattttgagatacgagggggctgcgcttaatgagaagaggggttttctcaccagctggatcgggctagcagacggattgtgtaatcggatgcgaaactctcgcaacaacatccagcttctccttcacattgtcaccgtctctgtgctccatgtcacggccctgctcgagcgactgaagtttggcgaggaaatctacaacgaaaacaataccgcaaggtggaagcaagatcttgtggacttgttcaagatgtacacattcgatatactccctcctatcttcaacgagtggcaggtgtggagggtgaggcagatcgagatcgaggcatggagaagaagggcccaatttggtccagttatgtttacgccggacagttctcatgctacagtggaggataagctctctggggagaaaatcacgtttcgggtaaactaccaatactcaacaacaattttctcagcagtttgtgaagatcacaagactcggatggggaacgaggccgttgccgacatggccagctgcatttcgcccacgtttgggtttcacaagctgctaccggccgatagtcaggcacagttctctccttatgataaaagcgcgttcggccgggtttttaggggcccatactctcaagatcttttgtggcgctccttcataaacgtcaaagacttcagatcgcgtccaactcgctttgaccagacggctcgcgacagagtccttgagatggtgataagagcagggcaccatgttgatgctatacaattttggtataatcacgcgaatgcaaatgctatgactgcagggacaatggctggaaacccttggggggggaatagatttcaagttgatgtgagaggtcggcccatacaagacttgcgcatggagtttgctaatgacgtgcttgcttccttgcaacttcgtttcaaagatggtacggcaacacaaagatttggcaacacacagggttgggcgtctaatgtagtgacttgtacaacccccgctggctacaggctcagctcatgggcctttcgtgaagatcccggcccctaccacacacaagccatcagtttactccgctttcaattcacccccgaggat

SEQ ID NO: 196 - DNA, 1494 bp, Polypodium billardieri
atggcagcgcccggcacaaaggactcagcagaaatggtcgctgacgtcggcactacgactactgtttccgtacctgattgggaggtgcaggacctggataaactggggctgcaggccaccaatgacatcgatgtgcttgccaattacatgcaaatggaggctcatgactggcataaccggatgagacgcgctgtgctggggctcatatccgccataccgaaggtgggtgccggtataagcatgctcatcggcttcttttggccagcgaacagggtggacatttgggtggccctcggcatggaggaatatgttcgaaacattgtgaagcaggaaattttcgaattcgaaatgcagcaacatcagtcggaaatcgaggcgctggaagctactattttgagatatgatcgggctgcgcttcctgagaaggggaattttctaagcatttggatctcacaagctgacagactaagcattcggttgagaaactctaccaacagaatccaccttctccttcacattgtcactgtggctgtgcttcatatggccgccatgcatgagcgattgacatttggcgaggaactctacggcataaaccataccacgaattggactaaagatcttttggatgtgtttgagatgtacacatccaatttagtcccaactctcttcaaggagtggaggcagtggagggaaagccagattgagatcagagcatgggtagtaaggggtgtatggggcaatattacttccacccccgacgtctctcatgcaacagtggaggataaaatctcaggggagagattcgtgtttcgagtaacgagacgaaactcaacaacaattttctcggatgtctgccaagatcacaaaactcggatggcaaatgaggccattgcagacatggcgagctgcatgtcgccgacttttgctttccacaagctcctaccgagcaatattcaagcgcaatttcctgcttatgataaggagctgtttgcgcaagtttttcgaggcccgtattcgcaggatctcatgcaggaactcttcacggcgctcaaagcgttcagaacacgcccaactcgctttgatcaaacagctcgcgacagaatcttggaggtgattgtaagagcggggcaccatgtcgatgctatacaattctggtacgatcatgtgaatgcaaatgcgatgactgcggggacgatggccgggaaccctgcaggagggagtaggcatcaagttgatgtgaggaatcggcgcatacaggatttgcgcttggagttcgctcaggatgtgcttgtttccttgcagttccattttgaagacggcacatcgacacaaaaattcggcaatgtagtgggttgggctactcgtatcgcaacctgtacaacccccgctggctacaggctcagctcatgggcctttcgtgaagatcagggcccctacaatacaaccgccatcagtgtcctccgcttccagttcacccctgaagatccctcccca

SEQ ID NO: 197 - DNA, 1494 bp, Polystichum braunii
atggcagcgcccggcattaaggacgttaatactgcttctgtgattgctccattaactgctgaggaggatcaattggtaattatgaaagcgcaacagatgatcggtgacgacgtagatctgctttccagaaacatgcaaatcgaggctcatgactggcataatcgaactagaggcgctatactggggctgatatccttagtccccacggtgggtgctggcataagcatgcttgtcggcctgttttggccagcaaacaaggtggacatttgggaggccatcaaagcggagcaatatgttaggaacattgtcaagcaggagatttttgaattcgaattgcagcaacttgagtccgacatcgaggcgctgcaaaccgctgtcgggagatacgatagagctggtgggcctactgagaggggcaattttctaagcatctggatcacgcaagctgacaatttgtctattcggttgcgaaactctagcaacaacatccaccttctccttcacattgtcaccgtggctgtgcttcatgtcgcagccctgcacgagcgactgacatttggcgaggaactctacggcgtaaaccatacagcaagttggaagcaagatcttgtggataaaatcgagatgtacacatccaatgtagtcccaaatatcttcaggaattggaagccgtggagggaaagccagattgagattacagcatggggaagaagggcccaatcgggcaatcttttttatcacccagcctcttctcatgctacagtggaggataagatctcaggggagatgttcacgtttcaggtaaccggccaaaactcaacaacaattttcttaggagtttgcgaagatcacaaaactcggatggtgaacgaggccattgcggacatggccagctgcatggcacccacttttgtgtttcacaagctcctacctgacgatgttcaaacgcagctctctccttatgataaggaggtgtttgggcgggttttcagaggcccatattcccaggatctttcgcagcgatccttcacgtctctcaaatccttcagatcgcatccaactcgctttgatcagacggctcgtgacagaatcttggaggtgatcataagagcggggaatcatgttgatgctatacaattttggtacgatcatgtgtcgaatccaaatgctatgactgaagggactatggccggaaaccctacgggggggaatagccataaggttgatgtgaggggtcggtccatacagcaattgcgcatggagttcgctaatgacgtgcttacttcgttgcaacttcgtttcgaagatggtacatcaacacagaaattcggcactgaacctggttggggatttagtatagaaacttgtacagccccctatggctacaggcttagctcatgggcctttcgtgaagataccggcccctacaactcaaccgccatcagtttactccgcttccaattcacccccgagctcgacgatattcctttggca

SEQ ID NO: 198 - DNA, 1491 bp, Lygodium japonicum
atggcaacgcccggcatgatggactcagctaaggacattaatactgtttctgtgcttgctccggctgctgaggaggtgcaggacgatcaattggtaatgacagctgcgccagacatgatggactcagtagatccgcaatcagcacaaatcgaggctcatgactggcataaccgcatgagaagcgctatactggcgctggcatccgcaatcccgaaggtgggtggtgccataagcatgctcatcagcatcttttggccagcaaacagggtggacatttgggaggccatcaatgcggagcaatatgttaggaacattgtccagcaagagatttttgaattcgaattgcggcaacttcagtccgacatccaggcgctggaagtcactgtttcgagatacgatacggctgcgcctaatgagagggggaattttctaagcatctggatcgcgcaagctgacgcattgagtattcggatgcgaaactctaccaacgacatccaccttctccttcacattgtcaccgtggctgtgcttcatgttgcagccctgcatgagcgactgacatttggcgaggaactctacggatcaaacaatacagcaaattggacgcaagatcttgtggatgtgttcgagatgtacacatccaatttaatcccaaatctcttcaacaagtggaagcagtggagggaaagccaaattgagattagagcatgggtagtaaggcccccatcgggcaatcttatttttagaccacccgtttctcatgctacagtggaggataagctctcaggggagatattcacgtttcgggcaaccaactctacctcaacaacaattttctcaggagtttgcgaagatcacaaaactcggatggtgaacgaggccattgcggacatggccagctgcatgtcacccacgttttcttttcacaagctcctgcccgacgatattcagacgcagttctctccttatgatagggaggtgttcgggcgggttttcagaggcccatattcccaggatcttttgcagccactcttcacgagtctcagatccttcagatcgcatccaactcgctttgatcagacgactcgcgacagaatcttggaggtgatcataagagcggggcaccatgttgacgcgatacaattttggtacgatcatgtgaatccaaatgctatgactgcagggactatggccggaaaccctgccggggggagaaggcatcaggttaatgtgagggatcggcccatacaggatttgcgcatggagttctctcagaacgtgcttgcttctttgcaacttcatttcgaagatggtacatcaacagcgagatttggcaatgaacttgggtgggcgtctagtatagcaacttgtacagccccctatggctacaggctcagctcatgggcctttcgtcaagatcccggcccctacggaacaaccgccatcagtgtactacgattccaattcacccccgagctggatttctcgtca

SEQ ID NO: 199 - DNA, 1491 bp, Lygodium japonicum
atggcaacgcccggcatgatggactcagctaaggacattaatactgtttctgtgcttgctccggctgctgaggaggtgcaggacgatcaattggtaatgacagctgcgccagacatgatggactcagtagatccgcaatcagcacaaatcgaggctcatgactggcataaccgcatgagaagcgctatactggcgctggcatccgcaatcccgaaggtgggtggtgccataagcatgctcatcagcatcttttggccagcaaacagggtggacatttgggaggccatcaatgcggagcaatatgttaggaacattgtccagcaagagatttttgaattcgaattgcggcaacttcagtccgacatccaggcgctggaagtcactgtttcgagatacgatacggctgcgcctaatgagagggggaattttctaagcatctggatcgcgcaagctgacgcattgagtattcggatgcgaaactctaccaacgacatccaccttctccttcacattgtcaccgtggctgtgcttcatgttgcagccctgcatgagcgactgacatttggcgaggaactctacggatcaaacaatacagcaaattggacgcaagatcttgtggatgtgttcgagatgtacacatccaatttaatcccaaatctcttcaacaagtggaagcagtggagggaaagccaaattgagattagagcatgggtagtaaggcccccatcgggcaatcttatttttagaccacccgtttctcatgctacagtggaggataagctctcaggggagatattcacgtttcgggcaaccaactctacctcaacaacaattttctcaggagtttgcgaagatcacaaaactcggatggtgaacgaggccattgcggacatggccagctgcatgtcacccacgttttcttttcacaagctcctgcccgacgatattcagacgcagttctctccttatgatagggaggtgttcgggcgggttttcagaggcccatattcccaggatcttttgcagccactcttcacgagtctcagatccttcagatcgcatccaactcgctttgatcagacgactcgcgacagaatcttggaggtgatcataagagcggggcaccatgttgacgcgatacaattttggtacgatcatgtgaatccaaatgctatgactgcagggactatggccggaaaccctgccggggggagaaggcatcaggttaatgtgagggatcggcccatacaggatttgcgcatggagttctctcagaacgtgcttgcttctttgcaacttcatttcgaagatggtacatcaacagcgagacttggcaatgaacttgggtgggcgtctagtatagcaacttgtacagccccctatggctacaggctcagctcatgggcctttcgtcaagatcccggcccctacggaacaaccgccatcagtgtactacgattccaattcacccccgagctggatttctcgtca

SEQ ID NO: 200 - DNA, 1491 bp, Lygodium japonicum
atggcaacgcccggcatgatggactcagctaaggacattaatactgtttctgtgcttgctccggctgctgaggaggtgcaggacgatcaattggtaatgacagctgcgccagacatgatggactcagtagatccgcaatcagcacaaatcgaggctcatgactggcataaccgcatgagaagcgctatactggcgctggcatccgcaatcccgaaggtgggtggtgccataagcatgctcatcagcatcttttggccagcaaacagggtggacatttgggaggccatcaatgcggagcaatatgttaggaacattgtccagcaagagatttttgaattcgaattgcggcaacttcagtccgacatccaggcgctggaagtcactgtttcgagatacgatacggctgcgcctaatgagagggggaattttctaagcatctggatcgcgcaagctgacgcattgagtattcggatgcgaaactctaccaacgacatccaccttctccttcacattgtcaccgtggctgtgcttcatgttgcagccctgcatgagcgactgacatttggcgaggaactctacggatcaaacaatacagcaaattggacgcaagatcttgtggatgtgttcgagatgtacacatccaatttaatcccaaatctcttcaacaagtggaagcagtggagggaaagccaaattgagattagagcatgggtagtaaggcccccatcgggcaatcttatttttagaccacccgtttctcatgctacagtggaggataagctctcaggggagatattcacgtttcgggcaaccaactctacctcaacaacaattttctcaggagtttgcgaagatcacaaaactcggatggtgaacgaggccattgcggacatggccagctgcatgtcacccacgttttcttttcacaagctcctgcccgacgatattcagacgcagttctctccttatgatagggaggtgttcgggcgggttttcagaggcccatattcccaggatcttttgcagccactcttcacgagtctcagatccttcagatcgcatccaactcgctttgatcggacgactcgcgacagaatcttggaggtgatcataagagcggggcaccatgttgacgcgatacaattttggtacgatcatgtgaatccaaatgctatgactgcagggactatggccggaaaccctgccggggggagaaggcatcaggttaatgtgagggatcggcccatacaggatttgcgcatggagttctctcagaacgtgcttgcttctttgcaacttcatttcgaagatggtacatcaacagcgagatttggcaatgaacttgggtgggcgtctagtatagcaacttgtacagccccctatggctacaggctcagctcatgggcctttcgtcaagatcccggcccctacggaacaaccgccatcagtgtactacgattccaattcacccccgagctggatttctcgtca

SEQ ID NO: 201 - DNA, 1503 bp, Dryopteris lepidopoda
atgacaacaccagacatgaatatggactcagttgatccgcatttagcacaagagacaatcgctgacgacgttaaaattgtttctgcgcctgttgctgctggtgctgaggagggacaggaggtcaccgtggatctgtttgccaactacaatatgcaaatggaggctcatgactggcataaccggcttagaggagctatactggggctgctatccgcagtcccgaaggtgggtgctgccgttagcaagctcatcggtctcttttggccagcaaacaaggtggacatttgggaggccatcaattgggagcaatatgttaggaacattgtcaagcaggagatttttgaattcgaactgcagcaacatgagtccgacatcgaggcgctgcaaaccactattcggagatacgatacggctgcgcctaatgagagggggaattttctaagcatctggatctcgcaagctgacacattgtgtattcggttgcgaaactctaccaacgacttccaccttctccttcacattgtcaccgtggctgtgcttcatgtcgcagccctgcatgagcgactgacattcggcgaggaactctacggctcaagcaatacagcaaattggacgcaagatcttgtggatgtgttcaagatgtacacatccgatttaatcccaaatctcttcaagaagtggaagcagtggagggtaacccagattgagattaaaaaatggacacaaaaaagcatcttaatgatcaattcttatgctacagtggaggataaggtctcaggggagatattcaactttcgggcacccaacctctattcaacaaagcagcacgtgttttcagaagtttgcgaagatcacaaaactcggatgatgaacgaggccattgcggacatggccagctgcttggcacccacttttgcttttcacaagctcctacccgaggatactcagacgcagtcctctccttatgataaggagctgttcgggcgggttttcagaggcccatattcccaggatcttttgcagccatccttcaatattatcaatcgaaccatatccttgagaatgcatccaactcgctttgatcagacgactcgcgacaaaatcttggaggtgatcataagagcgggttaccatgttgatgctatacaattttggtatgatcatgtgaatccaaatgccatgactgcagggactatggccggaaactctgtgggggggaataggtatcaggttgatgtgagggatcggcccatacaggatttgcgcatggagttcgctcaggacgtgcttgcttcgttgcaacttcattttgaagatggtacatcaacactgaaatttggcaatccaagtaatcttaattgggcaactagtatagcaacctgtacagtcccctttggctacaggctcagctcatgggcctttcgtgaagatgctagctcctacagtgcaaccgccatcagtgtactccgcttccaattcacccccgaggatattccctcgcca

SEQ ID NO: 202 - DNA, 1623 bp, Pteridium esculentum
atgcaaagcaagagtctcgactattccctctccctgttctacgttgatcaattaatagtaatggcagcgcccaccatgatgatggactcagctgatccgcaattagcgcaagaaatgatcgctgaggatgttgaggaggtgcaggacgatcaatcagtaatgacaatgccaggcatgatggactcggttgatccacaattagctcaagagatgattactgacgatgtttataatgcttttgtgcgtgctgctggtggtgctgaggacgggcaggaggtcaccgtagatctgcttgccagatacatgcaaatcgaggcacatgactggaataaccggataagagccgttatcctgggactggcatccgcagtcccgaaggtgggtgctgccataggaatgctcatcggcttcctttggccagcaaacaaggtggacatttgggaggccatcaatgcggagcaatatgttctgaacattgtcaggcaggagatttttgaactcgaaatgcggctatatcggtctgacatcgaggcattggaagcaactgttttgcgatacgatagggctgcacttaatgagaaagggaattttcttagcatctggatcacgcaagctcatgcattgtctattcggatgcgaaactctaccaacaacatccaccttctccttcacatcgtcaccgtggctacgcttcatgtcgcagccctgcacgagcggctgacgtttggcgaggaactctacggtgaaaacaatacagcaaattggaagaaagatcttgtggaggtgttcaagatgtacacatccgatatagtcccaactctattcaaaaattggaagccgtggagggaaagccagattgagattgaagcatggagagtaaggggccaatcaggcaatcttattgttcgcccagatgtttctcacgctacagtggaggataagctctcaggggagaaattcacgtttcgggtaataaaccaatactcaacaacaattttctcacaaatttgtcaagatcacaaaattcggatgatgaatgaggccattgcggacatggccagctgcatgtcacccacatttgggtttcacaagctcctacctgacgatattcaggcacagctccctgcttatgatagggagcagttcagtctggtttacagaggcccatattcccaggatcttttgcagccgctcttcacgaggctcaaagccttcagatcgcgtacaactcactttcataatacgttggaaagaatctcgcaggtggttataagagcggggcaccatgtcgatgctctacaatttttgtatgctgggtttgcagggcctattgccggaaaccctacgggggggtctaggcatcagttcgatgtgaggaatcggcccatacaggaaattcgcatggagttctctcatgacattcttgcttcgttgcaatttcattttgaagatggtacatcaacacagaaatttggcaatacacttggttgggcatcttctatagcaacttgtacagccccctctggctacatgttcacctcaaggggctttcgttcagatcccggcccctacggaacagctgccatcagtgtaatccgcttccatttcacccctgaggatccc

SEQ ID NO: 203 - DNA, 1533 bp, Pellaea falcata
atggcagctgaggacgtcaatattgtttctgagcttgctcccgctgctaacgaggtgcagaacgcagagtacgaggaggacccaatcttctcgcaattggcgcagaagatggtcgctgctgcggaggcgggggaggtccccgtggaccttcttgcccaatacatgcaagtggaggctcacgactggcataaccggatcagaggcgccgtactggggctgatatccgcagtgccgaaggtgggcgctgccataagcaggctcatcggcctcttttggccagcaaacagggtggacatttgggaggccctgaatgcggaggagtatatcaggaacattgtccagcaggagctttttgaattcgaaatgcagctcctgcggaacgacatcgaagcgctggaaaccactgttgcgagatacgatagggctgcgcttactgagaaggggaatttcctaagcatctggatctcgcaagctgatgcactgtatattcggatgcgaaactctaccaacaacatccaccttctccttcacatggtcaccgtgtcgacactacatctcgcagccctgcatgagcgactgacatttggcgaggaactctatggcacgaacaattcagcgaattggacgcaagatcttgtggataagttcgagctgtacacaaccgatttgatcccgagtgtttttaaaaggtggaaggactggaggccagcccaaattgagattacagcttgggtacaaaggggctcatgcggcattgttacctgtagaccaaacgtttcttatgctagagtggaggataaggtctccgggagaagaattacgtttcaggcatcgaatgtaaattcaacaacagttttctcaggagtttgtgaagatcacaaaactcggatgatgaacgaggccattgctgacatggccagctgcctgtcacccacttttgcttttcacaagctcctacccgccgacattcagccgcggttctctgcttttgatagggagcagttcggacaggttttcagaggtccatattcgcaggatctttcgcacggagcctggacgattctcaaagccttccgatcgcacacaactcgctctgatcagacgaatcgcgatagagtcttggagatgatcataagagcggggagccatgttgatgctatacagtttatgtacgatcatgcgaatccaaatgctacgactgcagggattatggctggaaactccgcgggagggaataggcatcgggtcgatgtgaggggtcggcacattcgggaattgcgcatggcgttcgctcgtgacgtgatttcttcgttgcaacttctttttgaggatggtacagcaacacggagatttggcgatgaacatgaaagctgggcgtctagaatactaacttgtacagtcccctatggctataggctcagctcatgggcctttcgtgaagatcccggcccctaccgaacaaccgccatcagtgtactccgcttccaattcaccccagagctggatattccgttgccagcgcaatatattata

SEQ ID NO: 204 - DNA, 1005 bp, Pellaea falcata
atggcagctgaggacgtcaatattgtttctgagcttgctcccgctgctaacgaggtgcagaacgcagagtacgaggaggacccaatcttctcgcaattggcgcagaagatggtcgctgctgcggaggcgggggaggtccccgtggaccttcttgcccaatacatgcaagtggaggctcacgactggcataaccggatcagaggcgccgtactggggctgatatccgcagtgccgaaggtgggcgctgccataagcaggctcatcggcctcttttggccagcaaacagggtggacatttgggaggccctgaatgcggaggagtatatcaggaacattgtccagcaggagctttttgaattcgaaatgcagctcctgcggaacgacatcgaagcgctggaaaccactgttgcgagatacgatagggctgcgcttactgagaaggggaatttcctaagcatctggatctcgcaagctgatgcactgtatattcggatgcgaaactctaccaacaacatccaccttctccttcacatggtcaccgtgtcgacactacatctcgcagccctgcatgagcgactgacatttggcgaggaactctatggcacgaacaattcagcgaattggacgcaagatcttgtggataagttcgagctgtacacaaccgatttgatcccgagtgtttttaaaaggtggaaggactggaggccagcccaaattgagattacagcttgggtacaaaggggctcatgcggcattgttacctgtagaccaaacgtttcttcgttgcaacttctttttgaggatggtacagcaacacggagatttggcgatgaacatgaaagctgggcgtctagaatactaacttgtacagtcccctatggctataggctcagctcatgggcctttcgtgaagatcccggcccctaccgaacaaccgccatcagtgtactccgcttccaattcaccccagagctggatattccgttgccagcgcaatatattata

SEQ ID NO: 205 - DNA, 1524 bp, Christella dentata
atggacatgaaggactcagaaatgatcggtggcgtcgctcctactacacttgtttcggaggagaatgcagaaacgatcgctgaggacgctaataatacaactgttggttctgaggccgccggggagctggataagctggcgctggagggcggcgacgatggcatcgatatgcttgccagacacatgcaagtggaggctaacgactggcataaccgcgtgagagacgctgtgctggcgctcatatcggacgtcccgatggtgggtacagccataagcatcctcatcggcctcttttggccagcaacccaggtgaacatttgggaggctctcaaggcggaggttacgaacattgtccggcgggagatttttgagttcgaaatgaggctgctcgagtccgacattgaggcgctggagaggaccatagtgagatatgagagggcctcgcttcttcatgagaagggggttttcctaggccattggatcacacaagcggacgcactggctattcggatgcgaaactccaacaacaggattcatcttctccttcatattgttaccgtggccgtgcttcacatggccgccctgcatgagcgactgacatttggcgaggaaatttacggcgtaaacaatacagcgaattggacgaccgaactcgtggaacagttcgagaggtacacgtccgataaagtcccgaacatcttcgaggagtggaggccgtggagggaaagccagattgagatcagagaatggagggtagcgggccaatgtggcaatcttacttgccgtccaagcgtttctcatgcgacagtggaggataaggtctcaggggcaaaattcgtgtttcgcgccaccaacgttttctcgacaacgattttctcagatctctgtcgaggtcacagaacacgaatgatgaatgaggccgttgcagacatggcaagctgtatgtcgcccacttttgcttttcacaccctcctacccagtgacattcaaatgcagttcagtccttacgataggcgggtgtttggccaagtttttcgaggcccatattcatggcatcttctgcaacatcaattattctacacatcgggacgaatctccttcataacgcagccaactctttttgatcgaacggatcgcgacagaatcttgcaggtgactatagtagaggggatgatctctcttcgagggatgcaattttggtacgatcacgcagatccaaatgctatgactccggggatgagagccggaaactttagtttagcagggaggccggatataattgacgtcgatgtgaggaatcgacccatacaacatttgcacttggagttcgccacagatgggaagttttcgttgcagatacagttcgaagatggtacatcaacacggaaattcggcaatggaatgtcaccgtggcttggtgataaagtagcttgtacaaccccctctggctacaggctcagctcatgggcttgttctcccttcgatctcgtccgcttcgaattcacccccgagattccctcgtcc

SEQ ID NO: 206 - DNA, 1524 bp, Christella dentata
atggacatgaaggactcagaaattatcggtggcgtcgctcctactacacttgtttcggaggagaatgcagaaacgatcgctgaggacgctaataatacaactgttggttctgaggccgccggggagctggataagctggcgctggagggcggcgacgatggcatcgatatgcttgccagacacatgcaagtggaggctaacgactggcataaccgcgtgagagacgctgtgctggcgctcatatcggacgtcccgatggtgggtacagccataagcatcctcatcggcctcttttggccagcaacccaggtgaacatttgggaggctctcaaggcggaggttacgaacattgtccggcgggagatttttgagttcgaaatgaggctgctcgagtccgacattgaggcgctggagaggaccatagtgagatatgagagggcctcgcttcttcatgagaagggggttttcctaggccattggatcacacaagcggacgcactggctattcggatgcgaaactccaacaacaggattcatcttctccttcatattgttaccgtggccgtgcttcacatggccgccctgcatgagcgactgacatttggcgaggaaatttacggcgtaaacaatacagcgaattggacgaccgaactcgtggaacagttcgagaggtacacgtccgataaagtcccgaacatcttcgaggagtggaggccgtggagggaaagccagattgagatcagagaatggagggtagcgggccaatgtggcaatcttacttgccgtccaagcgtttctcatgcgacagtggaggataaggtctcaggggcaaaattcgtgtttcgcgccaccaacgttttctcgacaacgattttctcagatctctgtcgaggtcacagaacacgaatgatgaatgaggccgttgcagacatggcaagctgtatgtcgcccacttttgcttttcacaccctcctacccagtgacattcaaatgcagttcagtccttacgataggcgggtgtttggccaagtttttcgaggcccatattcatggcatcttctgcaacatcaattattctacacatcgggacgaatctccttcataacgcagccaactctttttgatcgaacggatcgcgacagaatcttgcaggtgactatagtagaggggatgatctctcttcgagggatgcaattttggtacgatcacgcagatccaaatgctatgactccggggatgagagccggaaactttagtttagcagggaggccggatataattgacgtcgatgtgaggaatcgacccatacaacatttgcacttggagttcgccacagatgggaagttttcgttgcagatacagttcgaagatggtacatcaacacggaaattcggcaatggaatgtcaccgtggcttggtgataaagtagcttgtacaaccccctctggctacaggctcagctcatgggcttgttctcccttcgatctcgtccgcttcgaattcacccccgagattccctcgtcc

SEQ ID NO: 207 - DNA, 1524 bp, Christella dentata
atggacatgaaggactcagaaatgatcggtggcgtcgctcctactacacttgtttcggaggagaatgcagaaacgatcgctgaggacgctaataatacaactgttggttctgaggccgccggggagctggataagctggcgctggagggcggcgacgatggcatcgatatgcttgccagacacatgcaagtggaggctaacgactggcataaccgcgtgagagacgctgtgctggcgctcatatcggacgtcccgatggtgggtacagccataagcatcctcatcggcctcttttggccagcaacccaggtgaacatttgggaggctctcaaggcggaggttacgaacattgtccggcgggagatttttgagttcgaaatgaggctgctcgagtccgacattgaggcgctggagaggaccatagtgagatatgagagggcctcgcttcttcatgagaagggggttttcctaggccattggatcacacaagcggacgcactggctattcggatgcgaaactccaacaacaggattcatcttctccttcatattgttaccgtggccgtgcttcacatggccgccctgcatgagcgactgacatttggcgaggaaatttacggcgtaaacaatacagcgaattggacgaccgaactcgtggaacagttcgagaggtacacgtccgataaagtcccgaacatcttcgaggagtggaggccgtggagggaaagccagattgagatcagagaatggagggtagcgggccaatgtggcaatcttacttgccgtccaagcgtttctcatgcgacagtggaggataaggtctcaggggcaaaattcgtgtttcgcgccaccaacgttttctcgacaacgattttctcagatctctgtcgaggtcacagaacacgaatgatgaatgaggccgttgcagacatggcaagctgtatgtcgcccacttttgcttttcacaccctcctacccagtgacattcaaatgcagttcagtccttacgataggcgggtgtttggccaagtttttcgaggcccatattcatggcatcttctgcaacatcaattattctacacatcgggacgaatctccttcataacgcagccaactctttttgatcgaacggatcgcgtcagaatcttgcaggtgactatagtagaggggatgatctctcttcgagggatgcaattttggtacgatcacgcagatccaaatgctatgactccggggatgagagccggaaactttagtttagcagggaggccggatataattgacgtcgatgtgaggaatcgacccatacaacatttgcacttggagttcgccacagatgggaagttttcgttgcagatacagttcgaagatggtacatcaacacggaaattcggcaatggaatgtcaccgtggcttggtgataaagtagcttgtacaaccccctctggctacaggctcagctcatgggcttgttctcccttcgatctcgtccgcttcgaattcacccccgagattccctcgtcc

SEQ ID NO: 208 - DNA, 1491 bp, Lastreopsis tinarooensis
atggcagcgcccggcatggaggactcaaaaacgatagctgacgtcgtcactactactgtttctgtgccggctggggagatgcaggacctggatcaattggccctggatgtcaccaataatatcgatgggcttgccaaatacatgcaaatggaggctcatgactggcataaccgactgagaggcgctatattggggctcatatccgcagtcccgaaggtgggtgctgccataagcttgctcatcggcctcttctggccagcgaacagggtggacatttgggtggccctcaatgcggaagaatacattagaaacattgtcaagcaggagatttttgaattcgagatgcagcaacatcagtccagcatcgaggcgctggaagccactatttcgagatacgatcgggctgcacttactgagaaggggaattttctaagcatatggatctcacaagctgacacactgtctattcggttgcgaaactctaccaacaacatccaccttctccttcacattgtcaccgtggctgtgcttcatattgctgccatgcatgagcgactcacattcggcgaggaactctacggcatgaacaatacagtaaattggaagaaagatcttgtggatgtgttcgagatgtacacatccaatttagtcccgcgtctcttcaaggagtggaaggaatggagggaacgccaaattgagattaaagcatgggtagtaaggggtgtatggggcaatattactagcaccccagatgtttctcatgcaacagtggaggatacggtctcaggggagaaattcacatttcgggtaacgagacgaaactcaacaacaattttctcagacgtttgccaagatcacaaaactcggatgatgaatgaggccattgcagacatggccagctgcatgtcacccacttttggttttcacaagctcctaccgagcgatattcaggcgcagttctctccttttgataagcagctgttcggccaagtttttcgaggcccatattcccaagatcttttgcagccactcttcacgactctcaaaaccttcagatcacgtccaactcgctttgatcaaacggctcgcgacagagtcttggaggtgactataagagcagggcaccacattgatgctatacaattttggtatgatcatgtgaatccaaattctatgactgcagggactatggccggaaactctatgggggggagtaggcatcaggttgatgtgagggatcagcgcatacaggatttgcgattggagttctctcaagatgtgcttgcttcgttgcaacttcattttgaagatggtacatcaacacgaaaatttggcaatgaactgggttgggcttctaatatagtaacttgtacaaccccctctggctacaggctcagctcatgggcctttcgtgaagatcctggcccctacggaacaaccgccatcagtctactccgcttccaattcaaccccgaggaatatccttcgtca

SEQ ID NO: 209 - DNA, 1491 bp, Lastreopsis tinarooensis
atggcagcgcccggcatggaggactcaaaaacgatagctgacgtcgtcactactactgtttctgtgccggctggggagatgcaggacctggatcaattggccctggatgtcaccaataatatcgatgggcttgccaaatacatgcaaatggaggctcatgactggcataaccgactgagaggcgctatattggggctcatatccgcagtcccgaaggtgggtgctgccataagcttgctcatcggcctcttctggccagcgaacagggtggacatttgggtggccctcaatgcggaagaatacattagaaacattgtcaagcaggagatttttgaattcgagatgcagcaacatcagtccagcatcgaggcgctggaagccactatttcgagatacgatcgggctgcacttactgagaaggggaattttctaagcatatggatctcacaagctgacacactgtctattcggttgcgaaactctaccaacaacatccaccttctccttcacattgtcaccgtggctgtgcttcatattgctgccatgcatgagcgactcacattcggcgaggaactctacggcatgaacaatacagtaaattggaagaaagatcttgtggatgtgttcgagatgtacacatccaatttagtcccgcgtctcttcaaggagtggaaggaatggagggaacgccaaattgagattaaagcatgggtagtaaggggtgtatggggcaatattactagcaccccagatgtttctcatgcaacagtggaggatacggtctcaggggagaaattcacatttcgggtaacgagacgaaactcaacaacaattttctcagacgtttgccaagatcacaaaactcggatgatgaatgaggccattgcagacatggccagctgcatgtcacccacttttggttttcacaagctcctaccgagcgatattcaggcgcagttctctccttttgataagcagctgttcggccaagtttttcgaggcccatattcccaagatcttttgcagccactcttcacgactctcaaaaccttcagatcacgtccaactcgctttgatcaaacggctcgcgacagagtcttggaggtgactataagagcagggcaccacattgatgctatacaattttggtatgatcatgtgaatccaaattctatgactgcagggactatggccggaaactctatgggggggagtaggcatcaggttgatgtgagggatcagcgcatacaggatttgcgattggagttctctcaagatgtgcttgcttcgttgcaacttcattttgaagatggtacatcaacacgaaaatttggcaatgaactgggttgggcttctaatatagtaacttgtataaccccctctggctacaggctcagctcatgggcctttcgtgaagatcctggcccctacggaacaaccgccatcagtctactccgcttccaattcaaccccgaggaatatccttcgtca

SEQ ID NO: 210 - DNA, 1554 bp, Asplenium boltonii
atggcagccctggacatgaaggactcagaaatgatcgccggcgccgtcgctcctcctactgttgttttttccgaggaggacgctgaagtcgctgctactgcaactgctgtttgtgatcccggtggggaagagcttgaactggataaactggcactggagggcggcagcgacggcgtcgatcttcttgacaaacgcctgcaaatggacgcccacgactggagtaaccgcacgagaaacgttgtgttggcgtttatatcgctaataccgaatgtgggtggtgccgtatcgctcctcgttggctttttctggccaacgaacaaggtggacatttggcaggccctcaacatggaggcatatgtcaagaacattgtcaagcaggagatttttgagttcgaaatgaggcagcaccagtccgacattgaggcgctgcaaaataccgttcagagatacgataggggctcgcttcgtgaaaaggcgatttcgttgggcatctggatcaaagatgccgacgcactgtctattcggttgggaaactcccccaaccggattcatcttctcctccatttggtcaccgtggccgtgctccatatgaccgcattgcatgaacgactgacatttggcaaggaactttacggcacggacaatacggtgaattggacaaaagaacttgaagaacagttcgtaacgtacatgcagcgtcgattcccagaaatcttcgcggagtggaaggtgtggagggcaaaccagattgagatcagcgaatggagtaggagggcaagcggcgggggtatttataatccatcgtcttcttctgcgagagtggaggacaaggtctcaggggagagaatcgactttcacgtcctgtatcagaactcgacaacaatcttctcggctatttgttttgatcacaaaacaaggatgatgaatgaggccactgcagacatgagcagttgcctgtcgcccacttttgcttttcacaagctcctacccggctacatgcaaagcagatacgcacagtttgtttcctttacatttggccaagtttttagagggccgtactcatatgatcttctgcagcaacgcttcacggctctcaaaaccttcagatcgcgcccaactcatttcgatcaaacaggccgcaataaagtcttgcaggtgaatgtaagatctgggtctcttattgacgcgctacaacttgtgtacgatcatactgatcaaagtcgtacaactccggggattattgtcggaaactcgagaggggggacggaatccgtcgttgatgtgaggacacggcacatacaggattggcgcttggagttcgcttacgatgtgctagtttcgctgcagattcggttcgaagatggtacatcaacacaaaagttcggcaatgtaaaccggtggccttctagagcagtaacttgtacaaccccccttggctataggcttagcagatgggccctccgtgaagatgtaggccctgccagtccaactgacatcagcctcgtccgcttcgaattcaccctcgacgatccctcacggcactccttgcaacga

SEQ ID NO: 211 - DNA, 1554 bp, Asplenium boltonii
atggcagccctggacatgaaggactcagaaatgatcgccggcgccgtcgctcctcctactgttgttttttccgaggaggacgctgaagtcgctgctactgcaactgctgtttgtgatcccggtggggaagagcttgaactggataaactggcactggagggcggcagcgacggcgtcgatcttcttgacaaacgcctgcaaatggacgcccacgactggagtaaccgcacgagaaacgttgtgttggcgtttatatcgctaataccgaatgtgggtggtgccgtatcgctcctcgttggctttttctggccaacgaacaaggtggacatttggcaggccctcaacatggaggcatatgtcaagaacattgtcaagcaggagatttttgagttcgaaatgaggcagcaccagtccgacattgaggcgctgcaaaataccgttcagagatacgataggggctcgcttcgtgaaaaggcgatttcgttgggcatctggatcaaagatgccgacgcactgtctattcggttgggaaactcccccaaccggattcatcttctcctccatttggtcaccgtggccgtgctccatatgaccgcattgcatgaacgactgacatttggcaaggaactttacggcacggacaatacggtgaattggacaaaagaacttgaagaacagttcgtaacgtacatgcagcgtcgattcccagaaatcttcgcggagtggaaggtgtggagggcaaaccagattgagatcagcgaatggagtaggagggcaagcggcgggggtatttataatccatcgtcttcttctgcgagagtggaggacaaggtctcaggggagagaatcgactttcacgtcctgtatcagaactcgacaacaatcttctcggctatttgttttgatcacaaaacaaggatgatgaatgaggccactgcagacatgagcagttgcctgtcgcccacttttgcttttcacaagctcctacccggctacatgcaaagcagatacgcacagtttgtttcctttacatttgggcaagtttttagagggccgtactcatatgatcttctgcagcaacgcttcacggctctcaaaaccttcagatcgcgcccaactcgttttgatcaaacaggccgcaataaagtcttgcaggtgaatgtaagatctgggtctcttattgacgcgctacaacttgtgtacgatcatactgatcaaggtcgtacaactccggggattattgtcggaaactcgagaggggggacggaatccgtcgttgatgtgaggacacggcacatacaggattggcgcttggagttcgcttacgatgtgctagtttcgctgcagattcggttcgaagatggtacatcaacacaaaagttcggcaatgtaaaccggtggccttctagagcagtaacttgtacaaccccccttggctataggcttagcagatgggccctccgtgaagatgtaggccccgccagtacaactgacatcagcctcgtccgcttcgaattcaccctcgacgatccgacacggcactccttgcaacga

SEQ ID NO: 212 - DNA, 1572 bp, Campyloneurum xalapense
atggcagcgcctggcctgatgagctcacctgtaaagattgctgacggtgttcacgatagtgtctctgcgcctgccaccactgagggggtgcccgacgttgtcgtcgaagatcatggcatcaagattcttcctgcgtctgccgaggcggcggtggaagagacagatgttgttgtagagcagccgcagccagtgctgcagcttcccgactactacattgaagtgaccgctgatgactggcataaccggattaggagcgccatcctggagttgtcatccgcaatccccaaagtgggtaccgccgtgagttttctcctcggcctcttttggccagagagcaagctgaacattttcaagtccatcgagatggagaaatacatcaggaacatcgtcaagcaggagatctttgaatttgagcttcagcaacacatgtccgacatcgaggcgctggaagacactgtcaagagttacgatcgggctgcgctgagggagaaggggaattttctgactgcctggatcacgcaatctaacatcttggctacacggttacggaactctgcaaacaacatccacctcctcctccacatcgtcaccgtggccacgctccatatggcggccctgcatgagcggttcacgtttggcaaggaactctaccaggaagacaacacaacgaattggaaggcggaccttgtggctgcgttccggaggtatgcagtcgaagtattcccaaatatcttcaaacagtggaagcaatggagggaaagccaggttgagattgcgacctggtctagaagtggcggtggaaatattaactggactccgtcctcttcccatgccacggtggaggataagcactcaggggagtttatccggttcgtgcaatattacatacagtcgacaaccatcttcttaacggtctgtgaggaccacaagactcggatggggaacgaggccgttgcggatatggccagctacatatcacccacctttgcgtttcacaagctcctacctgatgatgtccggcagcagcactccgcatatgatgaggagcagtttggtcgggttttcagaggtccctattgtaaagaccttctattgcccaactactcagcctcaaatcgtgatgccccagaattcagatcgagtacaaaccgcaatgattctgttacgagtcgacacggtgtcgtcgaggtaactatacgaacagggcaccacatcgacgccatccagtttcgctatggtgccgcaggctcagggactcagctgggcgttatggcgggaaactcccgaggcggtaccgtcaggcagtttgatgtgaggcgccgggccatagaatcggtgcgcatggagttcgcggacaggtataacatactcgctgccatccagctcaattttgacgatggcaccaccacacggaggctcggcaatgagctggattggccgacccgggtggtgacttgtaccaccccttttggctacactctcagctcctgggcctaccgccaagataacggcccctacagtacagccgcccccagtgtgctccgcttccaatatgcccccccgatagaaccc

SEQ ID NO: 213 - DNA, 1572 bp, Campyloneurum xalapense
atggcagcgcctggcctgatgagctcacctgtaaagattgctgacggtgttcacgatagtgtctctgcgcctgccaccactgagggggtgcccgacgttgtcgtcgaagatcatggcatcaagattcttcctgcgtctgccgaggcggcggtggaagagacagatgttgttgtagagcagccgcagccagtgctgcagcttcccgcctactacattgaagtgaccgctgatgactggcataaccggattaggagcgccatcctggagttgtcatccgcaatccccgttgtgggtaccggcgtgagttttctcctgggcctcttttggtcagagagcaagctgaacattttcaagtccatcgagatggagaaatacatcaggaacatcgtcaagcaggagatctttgaatttgagcttcagcaacacatgtccgacatcgaggcgctggaagacactgtcaagagttacgatcgggctgcgctgagggagaaggggaattttctgactgcctggatcacgcaatctaacatcttggctacacggttacggaactctgcaaacaacatccacctcctcctccacatcgtcaccgtggccacgctccatatggcggccctgcatgagcggttcacgtttggcaaggaactctaccaggaagacaacacaacgaattggaaggcggaccttgtggctgcgttccggaggtatgcagtcgaagtattcccaaatatcttcaaacagtggaagcaatggagggaaagccaggttgagattgcgacctggtctagaagtggcggtggaaatattaactggactccgtcctcttcccatgccacggtggaggataagcactcaggggagtttatccggttcgtgcaatattacatacagtcgacaaccatcttcttaacggtctgtgaggaccacaagactcggatggggaacgaggccgttgcggatatggccagctacatatcacccacctttgcgtttcacaagctcctacctgatgatgtccggcagcagcactccgcatatgatgaggagcagtttggtcgggttttcagaggtccctattgtaaagaccttctattgcccaactactcagcctcaaatcgtgatgccccagaattcagatcgagtacaaaccgcaatgattctgttacgagtcgacacggtgtcgtcgaggtaactatacgaacagggcaccacatcgacgccatccagtttcgctatggtgccgcaggctcagggactcagctgggcgttatggcgggaaactcccgaggcggtaccgtcaggcagtttgatgtgaggcgccgggccatagaatcggtgcgcatggagttcgcggacaggtataacatactcgctgccatccagctcaattttgacgatggcaccaccacacggaggctcggcaatgagctggattggccgacccgggtggtgacttgtaccaccccttttggctacactctcagctcctgggcctaccgccaagataacggcccctacagtacagccgcccccagtgtgctccgcttccaatatgcccccccgatagaaccc

SEQ ID NO: 214 - DNA, 1521 bp, Colysis ampla
atggcagctacggacgttaacactgtttctaagcttgctcccgctgctgaggaggtgcagaacgcagacatggccgaggaggacccgattttctcgcagctagcgcagaagatggctgctgctgcggagcggggggaggtccccgtagatcttcttgccaaatacatgcaagtggaggctcatgactggcataaccggatcagaggcgccacactggggctgatatccgcagtgccgaaggtgggtgctgccataagcaagctcatcggcctcttttggccaacaaacaaggtggacatttgggaggccatcaatgcggagcaatatatcaggaacattgtccagcgggagctttttgaattcgaaatgcagctccttcggaacgacatcgaagcgctggaaaccactgttgcgagatacgatagggctgcacttaatgctgagaaggggaattttctaagcatctggatctcgcaagctgatgcattgtttattcggatgcgaaactctaccaacaacatccaccttctccttcacatggtcaccgtgtctacacttcatctcgcagccctgcatgagcgactgacatttggggaggaactctatggcacaaacaattcagcgaattggacgcaagatcttgtggacaagtttgcggcgtacacgaccaatttaatccccaatgttttcaaaaggtggaaggattggaggccgacccagatcgagattacagcatcgtcacgcaggcagaattgcggcaatcttacctgcaggccagccatgtcttttgctgcagtggaggataggatgtccggggcaatattctcgtttcaggcaacgaatatacaatcaacaaccattttctcgggagtttgccaagatcacaaaactcggatgacgaacgaggccattgctgacatggcgagctgcctgtcacccacttttgcttttcacaagctcctacccgatgatattcaggcgcggttctctccttacgatagggagcagttcggacgggtgttcagaggcccatattccgaggatctttcgcacggattctggacggttaacaaagccttcagatcgcacacaactcgctctgatcagacagctcgcgatagaatcttggaggtgatcatcagagcggaggcccatgttgatgctatacagttcatgtacgatcatgtgaatccaaatgctacgactccagggattatggctggaaaccccacgggatcgatcaggtatgaggttgatgtgagggatcgccccatacaggaattgcgcatggagttctctcggaatgtgcttgcttcgttgcagcttcatttccaggatggtacagcaacacaaaaattcggcaatgtaaatggttgggcgtctaggattctaacttgtacagccccctatggctacaggttcagctcatgggcctttcatgaagatcccggcccttgggcaacaaccgccatcagtgtactccgcttccaattcaccccggagctcgatattcccttgtca

SEQ ID NO: 215 - DNA, 1521 bp, Colysis ampla
atggcagctacggacgttaacactgtttctaagcttgctcccgctgctgaggaggtgcagaacgcagacatggtcgaggaggacccgattttctcgcagctagcgcagaagatggctgctgctgcggagcggggggaggtccccgtagatcttcttgccaaatacatgcaagtggaggctcatgactggcataaccggatcagaggcgccacactggggctgatatccgcagtgccgaaggtgggtgctgccataagcaagctcatcggcctcttttggccaacaaacaaggtggacatttgggaggccatcaatgcggagcaatatatcaggaacattgtccagcgggagctttttgaattcgaaatgcagctccttcggaacgacatcgaagcgctggaaaccactgttgcgagatacgatagggctgcacttaatgctgagaaggggaattttctaagcatctggatctcgcaagctgatgcattgtttattcggatgcgaaactctaccaacaacatccaccttctccttcacatggtcaccgtgtctacacttcatctcgcagccctgcatgagcgactgacatttggggaggaactctatggcacaaacaattcagcgaattggacgcaagatcttgtggacaagtttgcggcgtacacgaccaatttaatccccaatgttttcaaaaggtggaaggattggaggccgacccagatcgagattacagcatcgtcacgcaggcagaattgcggcaatcttacctgcaggccagccatgtcttttgctgcagtggaggataggatgtccggggcaatattctcgtttcaggcaacgaatatacaatcaacaaccattttctcgggagtttgccaagatcacaaaactcggatgacgaacgaggccattgctgacatggcgagctgcctgtcacccacttttgcttttcacaagctcctacccgatgatattcaggcgcggttctctccttacgatagggagcagttcggacgggtgttcagaggcccatattccgaggatctttcgcacggattctggacggttaacaaagccttcagatcgcacacaactcgctctgatcagacagctcgcgatagaatcttggaggtgatcatcagagcggaggcccatgttgatgctatacagttcatgtacgatcatgtgaatccaaatgctacgactccagggattatggctggaaaccccacgggatcgatcaggtatgaggttgatgtgagggatcgccccatacaggaattgcgcatggagttctctcggaatgtgcttgcttcgttgcagcttcatttccaggatggtacagcaacacaaaaattcggcaatgtaaatggttgggcgtctaggattctaacttgtacagccccctatggctacaggttcagctcatgggcctttcatgaagatcccggcccttgggcaacaaccgccatcagtgtactccgcttccaattcaccccggagctcgatattcccttgtca

SEQ ID NO: 216 - DNA, 1521 bp, Colysis ampla
atggcagctacggacgttaacactgtttctaagcttgctcccgctgctgaggaggtgcagaacgcagacatggccgaggaggacccgattttctcgcagctagcgcagaagatggctgctgctgcggagcggggggaggtccccgtagatcttcttgccaaatacatgcaagtggaggctcatgactggcataaccggatcagaggcgccacactggggctgatatccgcagtgccgaaggtgggtgctgccataagcaagctcatcggcctcttttggccaacaaacaaggtggacatttgggaggccatcaatgcggagcaatatatcaggaacattgtccagcgggagctttttgaattcgaaatgcagctccttcggaacgacatcgaagcgctggaaaccactgttgcgagatacgatagggctgcacttaatgctgagaaggggaattttctaagcatctggatctcgcaagctgatgcattgtttattcggatgcgaaactctaccaacaacatccaccttctccttcacatggtcaccgtgtctacacttcatctcgcagccctgcatgagcgactgacatttggggaggaactctatggcacaaacaattcagcgaattggacgcaagatcttgtggacaagtttgcggcgtacacgaccaatttaatccccaatgttttcaaaaggtggaaggattggaggccgacccagatcgagattacagcatcgtcacgcaggcagaattgcggcaatcttacctgcaggccagccatgtcttttgctgcagtggaggataggatgtccggggcaatattctcgtttcaggcaacgaatatacaatcaacaaccattttctcgggagtttgccaagatcacaaaactcggatgacgaacgaggccattgctgacatggcgagctgcctgtcacccacttttgcttttcacaagctcctacccgatgatattcaggcgcggttctctccttacgatagggatcagttcggacgggtgttcagaggcccatattccgaggatctttcgcacggattctggacggttaacaaagccttcagatcgcacacaactcgctctgatcagacagctcgcgatagaatcttggaggtgatcatcagagcggaggcccatgttgatgctatacagttcatgtacgatcatgtgaatccaaatgctacgactccagggattatggctggaaaccccacgggatcgatcaggtatgaggttgatgtgagggatcgccccatacaggaattgcgcatggagttctctcggaatgtgcttgcttcgttgcagcttcatttccaggatggtacagcaacacaaaaattcggcaatgtaaatggttgggcgtctaggattctaacttgtacagccccctatggctacaggttcagctcatgggcctttcatgaagatcccggcccttgggcaacaaccgccatcagtgtactccgcttccaattcaccccggagctcgatattcccttgtca

SEQ ID NO: 217 - DNA, 1521 bp, Colysis ampla
atggcagctacggacgttaacactgtttctaagcttgctcccgctgctgaggaggtgcagaacgcagacatggccgaggaggacccgattttctcgcagctagcgcagaagatggctgctgctgcggagcggggggaggtccccgtagatcttcttgccaaatacatgcaagtggaggctcatgactggcataaccggatcagaggcgccacactggggctgatatccgcagtgccgaaggtgggtgctgccataagcaagctcatcggcctcttttggccaacaaacaaggtggacatttgggaggccatcaatgcggagcaatatatcaggaacattgtccagcgggagctttttgaattcgaaatgcagctccttcggaacgacatcgaagcgctggaaaccactgttgcgagatacgatagggctgcacttaatgctgagaaggggaattttctaagcatctggatctcgcaagctgatgcattgtttattcggatgcgaaactctaccaacaacatccaccttctccttcacatggtcaccgtgtctacacttcatctcgcagccctgcatgagcgactgacatttggggaggaactctatggcacaaacaattcagcgaattggacgcaagatcttgtggacaagtttgcggcgtacacgaccaatttaatccccaatgttttcaaaaggtggaaggattggaggccgacccagatcgagattacagcatcgtcacgcaggcagaattgcggcaatcttacctgcaggccagccatgtcttttgctgcagtggaggataggatgtccggggcaatattctcgtttcaggcaacgaatatacaatcaacaaccattttctcgggagtttgccaagatcacaaaactcggatgacgaacgaggccattgctgacatggcgagctgcctgtcacccacttttgcttttcacaagctcctacccgatgatattcaggcgcggttctctccttacgatagggagcagttcggacgggtgttcagaggcccatattccgaggatctttcgcacggattctggacggttaacaaagccttcagatcgcacacaactcgctctgatcagacagctcgcgatagaatcttggaggtgatcatcagagcggaggcccgtgttgatgctatacagttcatgtacgatcatgtgaatccaaatgctacgactccagggattatggctggaaaccccacgggatcgatcaggtatgaggttgatgtgagggatcgccccatacaggaattgcgcatggagttctctcggaatgtgcttgcttcgttgcagcttcatttccaggatggtacagcaacacaaaaattcggcaatgtaaatggttgggcgtctaggattctaacttgtacagccccctatggctacaggttcagctcatgggcctttcatgaagatcccggcccttgggcaacaaccgccatcagtgtactccgcttccaattcaccccggagctcgatattcccttgtca

SEQ ID NO: 218 - DNA, 1650 bp, Asplenium dimorphum
atgctcagcgtcaagcagctgtgcaaggcaaagaatcaagtagtaattatggcaggcttggatgacatgaagggctcagaaatgaccgctggcggggtcgctactgatccagcagctactgacgttgtttctgaggaggactcggaaacaacggtcgctgaagtcgctactgcaactactgacgttgttggtgaagtgctggaactggataaactggcgctggagggcggcggcggcggcggcggcggcggcggcatcgatgtgcttgccaaacacatgcaaatggaggcccacgactggcataaccgcctgagaggcgctgtgctggccctcctatccgccgtcccgaaggtgggtggtgccatcagcaccctcgtcggcctcttttggccagccaacaaggtaaacatttgggaggccctcggcttggaggcatatgttaccaacattgtcctgaaggagatctttgagttggaaatgcggctgtatgagtccgacattgaggcgctggaaaggagcattctgagatatgagaggggctcgcttcctgagaaggggattgccctaggcatctggatcgcacaagccgacacactgtctattcggatggcaaggtcctccaacaggattcatcttcttctccatatcgtcaccgtggccgtgctccatatggccgcactgcatgagcgactggaattcggcgaggaaatctacggcacaaacaatacagcgaattggacaaaagatctggaagaacagttccagacgtacacgtccgatcaaatcccagttatcttcaaggagtggaggccgtggagggaaagccagattgagatcagagcatggaggagacgggcaagcggcaatgttacctttaacccaaatgcttcctttgcgacagtggaggacaagatctcaggggagatattcaatttcagcgtgaactttcactactcgacaacgattttctcagatatttgtgaagctcacaaaacaaggatgatgaatgaggccaatgcagacatggccagttgcatatcgcccacgtttgcttttcacaacctcctacccagcgacggtcaagccaagttctctccttacgataggcagctcttcgggcaagtctttcgagggccattttcacaggatctcctgcagccacgcttcaccagtctcaaaaccttcagaatgcacccaactcgttccgatattacggtccgcaatagaatcttggaggtgactgtaagagctgggtcccttcttgaagcgatacgatttatgtacgatcatctgaatgtaaattctatgacttcggggattttggccggaaacccgagaggcggggagagtttcaccgtggatgtgaggggacggcgcatacaggatttgcgcttggagttctcccgagatgtgctagtgtcgctgcagatccggttcgaagatggtacatccacccaaaaattcggcaatgcagccgggtgggctactagtacagtaacttgtacaaccccctctggctacaggctcagctcctgggcctttcgtgaagacacaggccccaacgctacaactgccatcagcgtcgcccgctatgaattcacccccgacgatatttccgtgccatggtcaatccccgccccccgcctcctt

SEQ ID NO: 219 - DNA, 1578 bp, Doryopteris cordata
atggcagctgagccggacgttaaacatactggatccgagcttgctactcccgctgctgacgaggtgcagaagaccgtcccggcagcagctggtgctgaggacatgcaggaggccaacgaggacccgattttcgcgcagttggcgcaggagatgcaggtcgctgctgagaaagggcaggaggtccccgtggtagatctgatagacaaatacatgcaagtggaggctcacgactggcataaccgggttagaggcgccatcctggggctcatatccttagtgccgaaggtgggtagtgcgatcagcaagctcatcggcctcttttggccagccaacagggtgcacatttgggaggccctcaggttggagcaatatgtgcggaacattgtgcagcaggagatttttgacttcgaaatgcagctgcttcgctccgacatcgaagcgctggaaagcacagtcgccagatacgatatggctgcccttccggagaaggggaattttctgagcatttggatctcacaggctgacgcattgtattttcgtctgcgaaactctaccaacaacatgcaccttctccttcacattgtcaccgtgtctacgcttcatatggcagccttgcatgagcgactgatatttggcgaggaactctacggtacaaacaatgcagcaaattggacgcaagatcttgtaactaagttcagactatacacagatgatttgatcccaagtatcttcaaaaggtggaaggaatggagggaagcccagattgagattagagcatgggtaaacaggggctcctgcggcaatcttgtttgtagacctaatgtttctcatgctaccgtggaggataaaatctcaggggcgcgattcacgtttcaggcaacgaaccaaaactccacaaccattttctcagctatttgcgaagatcacaaaactcgaatggtgaacgaggccgttgccgacatggccagctgcctgtcacccacgtttgcttttcacaagctcctaccggacaacattcagccgcagttctctgcttacgatagggagcagttcgggcaggttttcagaggcccatattcgcaggatctttcgcatggagcatggatgaatctgaaatccttcagatcgcgtcccacgagcttcgatcagacagcgcgcgacagagtgttggagatgaacataagagcggggcaccatgttgatgcgatacgcttttggtacgaccatgcgaattcaaattcgatgactgcaggagttatggctggaaatcctgtgggaggggttagccatcaggttgatgtgaggggtcgactgatacaggatttgcgcatggagttctcgcacgacatacttgctgcactgcaactgcattttctggatggcacgtctacacggaaattcggcaacgagcttggttgggcatctcgaatattaacttgtacagccccctatggctaccggctcagctcatgggccttccgccaagatgcaggcccctacggaaccgccgccatcagcgtgctccgtttccagttcacccccgagctggattttcccgtgccagaagaatacagcgtc

SEQ ID NO: 220 - DNA, 1578 bp, Doryopteris cordata
atggcagctgagccggacgttaaacatactggatccgagcttgctactcccgctgctgacgaggtgcagaagaccgtcccggcagcagctggtgctgaggacatgcaggaggccaacgaggacccgattttcgcgcagttggcgcaggagatgcaggtcgctgctgagaaagggcaggaggtccccgtggtagatctgatagacaaatacatgcaagtggaggctcacgactggcataaccgggttagaggcgccatcctggggctcatatccttagtgccgaaggtgggtagtgcgatcagcaagctcatcggcctcttttggccagccaacagggtgcacatttgggaggccctcaggttggagcaatatgtgcggaacattgtgcagcaggagatttttgacttcgaaatgcagctgcttcgctccgacatcgaagcgctggaaagcacagtcgccagatacgatatggctgcccttcaggagaaggggaattttctgagcatttggatctcacaggctgacgcattgtattttcgtctgcgaaactctagcaacaacatgcaccttctccttcacattgtcaccgtgtctacgcttcatatggcagccttgcatgagcgactgatatttggcgaggaactctacggtacaaacaatgcagcaaattggacgcaagatcttgtaactaagttcagactatacacagttgatttgatcccaagtatcttcaaaaggtggaaggaatggagggaagcccagattgagattaatgcatgggtaaacaggggctcctgcggcaatcttgtttgtagacctaatgtttctcatgctaccgtggaggataaaatctcaggggcgcgattcacgtttcaggcaacgaaccaaaactccacaaccattttctcagctatttgcgaagatcacaaaactcgaatggtgaacgaggccgttgccgacatggccagctgcctgtcacccacgtttgcttttcacaagctcccaccggacaacattcagccgcagttctctgcttacgatagggagcagttcgggcaggttttcagaggcccatattcgcaggatctttcgcatggagcatggatgaatctgaaatccttcagatcgcgtccgacgagcttcgatcagacagcgcgcgacagagtgttggaggtgaacataagagcggggcaccatgttgatgcgatacgcttttggtacgaccatgcgaattcaaattctatgactgcaggagttatggctggaaatcctgtgggaggggtgagccatcaggttgatctgaggggtcgactgatacaggatttgcgcatggagttctcgcacgacatacttgctgcactgcaactgcatttcctggatggcacgtctacacggaaattcggcaacgagcttggttgggcatctcgaatattaacttgtacagccccctatggctaccggctcagctcatgggccttccgccaagatgcaggcccctacggaaccgccgccatcagcgtgctccgtttccagttcacccccgagctggattttcccgtgccagaagaatacagcgtc

SEQ ID NO: 221 - DNA, 1578 bp, Doryopteris cordata
atggcagctgagccggacgttaaacatactggatccgagcttgctactcccgctgctgacgaggtgcagaagaccgtcccggcagcagctggtgctgaggacatgcaggaggccaacgaggacccgattttcgcgcagttggcgcaggagatgcaggtcgctgctgagaaagggcaggaggtccccgtggtagatctgatagacaaatacatgcaagtggaggctcacgactggcataaccgggttagaggcgccatcctggggctcatatccttagtgccgaaggtgggtagtgcgatcagcaagctcatcggcctcttttggccagccaacagggtgcacatttgggaggccctcaggttggagcaatatgtgcggaacattgtgcagcaggagatttttgacttcgaaatgcagctgcttcgctccgacatcgaagcgctggaaagcacagtcgccagatacgatatggctgcccttcaggagaaggggaattttctgagcatttggatctcacaggctgacgcattgtattttcgtctgcgaaactctagcaacaacatgcaccttctccttcacattgtcaccgtgtctacgcttcatatggcagccttgcatgagcgactgatatttggcgaggaactctacggtacaaacaatgcagcaaattggacgcaagatcttgtaactaagttcagactatacacagttgatttgatcccaagtatcttcaaaaggtggaaggaatggagggaagcccagattgagattaatgcatgggtaaacaggggctcctgcggcaatcttgtttgtagacctaatgtttctcatgctaccgtggaggataaaatctcaggggcgcgattcacgtttcaggcaacgaaccaaaactccacaaccattttctcagctatttgcgaagatcacaaaactcgaatggtgaacgaggccgttgccgacatggccagctgcctgtcacccacgtttgcttttcacaagctcctaccggacaacattcagccgcagttctctgcttacgatagggagcagttcgggcaggttttcagaggcccatattcgcaggatctttcgcatggagcatggatgaatctgaaatccttcagatcgcgtccgacgagcttcgatcagacagcgcgcgacagagtgttggaggtgaacataagagcggggcaccatgttgatgcgatacgcttttggtacgaccatgcgaattcaaattctatgactgcaggagttatggctggaaatcctgtgggaggggtgagccatcaggttgatctgaggggtcgactgatacaggatttgcgcatggagttctcgcacgacatacttgctgcactgcaactgcatttcctggatggcacgtctacacggaaattcggcaacgagcttggttgggcatctcgaatattaacttgtacagccccctatggctaccggctcagctcatgggccttccgccaagatgcaggcccctacggaaccgccgccatcagcgtgctccgtttccagttcacccccgagctggattttcccgtgccagaagaatacagcgtc

SEQ ID NO: 222 - DNA, 1578 bp, Doryopteris cordata
atggcagctgagccggacgttaaacatactggatccgagcttgctactcccgctgctgacgaggtgcagaagaccgtcccggcagcagctggtgctgaggacatgcaggaggccaacgaggacccgattttcgcgcagttggcgcaggagatgcaggtcgctgctgagaaagggcaggaggtccccgtggtagatctgatagacaaatacatgcaagtggaggctcacgactggcataaccgggttagaggcgccatcctggggctcatatccttagtgccgaaggtgggtagtgcgatcagcaagctcatcggcctcttttggccagccaacagggtgcacatttgggaggccctcaggttggagcaatatgtgcggaacattgtgcagcaggagatttttgacttcgaaatgcagctgcttcgctccgacatcgaagcgctggaaagcacagtcgccagatacgatatggctgcccttccggagaaggggaattttctgagcatttggatctcacaggctgacgcattgtattttcgtctgcgaaactctaccaacaacatgcaccttctccttcacattgtcaccgtgtctacgcttcatatggcagccttgcatgagcgactgatatttggcgaggaactctacggtacaaacaatgcagcaaattggacgcaagatcttgtaactaagttcagactatacacagatgatttgatcccaagtatcttcaaaaggtggaaggaatggagggaagcccagattgagattagagcatgggtaaacaggggctcctgcggcaatcttgtttgtagacctaatgtttctcatgctaccgtggaggataaaatctcaggggcgcgattcacgtttcaggcaacgaaccaaaactccacaaccattttctcagctatttgcgaagatcacaaaactcgaatggtgaacgaggccgttgccgacatggccagctgcctgtcacccacgtttgcttttcacaagctcctaccggacaacattcagccgcagttctctgcttacgatagggagcagttcgggcaggttttcagaggcccatattcgcaggatctttcgcatggagcatggatgaatctgaaatccttcagatcgcgtcccacgagcttcgatcagacagcgcgcgacagagtgttggaggtgaacataagagcggggcaccatgttgatgcgatacgcttttggtacgaccatgcgaattcaaattcgatgactgcaggagttatggctggaaatcctgtgggaggggttagccatcaggttgatgtgaggggtcgactgatacaggatttgcgcatggagttctcgcacgacatacttgctgcactgcaactgcattttctggatggcacgtctacacggaaattcggcaacgagcttggttgggcatctcgaatattaacttgtacagccccctatggctaccggctcagctcatgggccttccgccaagatgcaggcccctacggaaccgccgccatcagcgtgctccgtttccagttcacccccgagctggattttcccgtgccagaagaatacagcgtc

SEQ ID NO: 223 - DNA, 1527 bp, Nephrolepis exaltata
atggcaggatataatcacgtgcaggtttctgagctacctcccgctgctgatcagaaggagcagaacgacgccacaggcatggccgaagaggacccaatttttgcgcaattagcgcagaaaatggctgctgctgcagagaaggaggaggcccccgtagatcttcttgcgcaatacatgcaagtggaggctcatgactggcataaccggatcagaggcgccatattggggctgatatccgcagtgccgaaggtgggtgctgctataagcaggctcatcggcctcttttggccatcaaacaaggtggacatttgggaggccctcaacgcggaggagtatatcaggaacattgtccagcaggagcttttcgaattcgaaatgcagcttcttcagaacgacatccaagcgctggaaaccacggttgggagatacgatacggctgcacttactgaaaagggcaactttctaagcatctggatctcgcaagctgatgcgttgtatattcggatgcgaaactctaccaacaacatccaccttctccttcacatggtcaccgtgtctacacttcatctcgcagccctacatgagcgactcacatttggcgaggaactgtatggcacaaacaatgcagcgaattggacacaagatcttgtggataagttcgagaggttcacaaccgatttaatcccgactgttttcagaaggtggaaggaatggaggccaacccagatcgagattacaacatgggtacgcaggggctcatgtggcaatcttacttgtagaccagacgtttcttatgctacagtggaggacaagatctccggggcattattctcattccaggcaacaaatcgaaactccacaacaattttctcagaagtctgcgaagaccacaaaactcgaatggtgaacgaggccattgcggacatggcgagctgcctgtcacccacttttgctttccacaagctcctacccgacgatattcagacgcagttctctccttacgatcggcagcaatttggacaggttttcagaggcccatattcccaggatctttcgcacggactctggacggttttcaaatccttcagatcgcgcacaacacgctctgatcagacacttcgcgatagaatcttggaggtgatcataagagcggggcaccatgttgatgctatacagttcgtgtacgatcatgtgaatccaaattctacgactccggggattgtggctggaaatgccgcgggaggaactaggcatcagattgatgtgagggatcggcccataaaggaagtgcgcatggagttctctcaggatgtgcttgcttcgttgcagctccattttgaggatggcacatcaacacggaaattcggcaatgaacttggttgggcgactagaatactaacttgtacagtgccctatggctacaggttcagctcatgggcctttcgtgaagatcctggcccctacagaacaaccgccatcagtgtactccgcttccaattcacccctgagctggatatgcccttgcca

SEQ ID NO: 224 - DNA, 1566 bp, Nephrolepis exaltata
atggcaggatataatcacgtgcaggatcaattagtaatggcagcagctgaggatgttaatactgtttctgagctagctcccgctgctgatcagaaggagcagaacgacgccacaggcatggccgaagaggacccaatttttgcgcaattagcgcagaaaatggctgctgctgcagagaaggaggaggcccccgtagatcttcttgcgcaatacatgcaagtggaggctcatgactggcataaccggatcagaggcgccatattggggctgatatccgcagtgccgaaggtgggtgctgctataagcaggctcatcggcctcttttggccatcaaacaaggtggacatttgggaggccctcaacgcggaggagtatatcaggaacattgtccagcaggagcttttcgaattcgaaatgcagcttcttcagaacgacatccaagcgctggaaaccacggttgggagatacgatacggctgcacttactgaaaagggcaactttctaagcatctggatctcgcaagctgatgcgttgtatattcggatgcgaaactctaccaacaacatccaccttctccttcacatggtcaccgtgtctacacttcatctcgcagccctacatgagcgactcacatttggcgaggaactgtatggcacaaacaatgcagcgaattggacacaagatcttgtggataagttcgagaggtacacaaccgatttaatcccgaatgttttcagaaggtggaaggaatggaggccaacccagatcgagattacaacatgggtacgcaggggctcatgcggcaatcttacttgtagaccagacgtttcttatgctacagtggaggacaagatctccggggcattattctcattccaggcaacaaatcgaaactcgacaacaattttctcagaagtttgcgaagaccataaaactcgaatggtgaacgaggccattgcggacatggcgagctgcctgtcacccacttttgctttccacaagctcctacccgatgatattcagacgcagttctctccttacgatcggcagcaatttggacaggttttcagaggcccatattcccaggatctttcgcacggactctggacggttttcaaatccttcagatcgcgcacaacacgctctgatcagacacttcgcgatagaatcttggaggtgatcataagagcggggcaccatgttgatgctatacagttcgtgtacgatcatgtgaatccaaattctacgactccggggattgtggctggaaatgccgcgggaggaactaggcatcagattgatgtgagggatcggcccataaaggaagtgcgcatggagttctctcaggatgtgcttgcttcgttgcagctccattttgaggatggcacatcaacacggaaattcggcaatgaacttggttgggcgactagaatactaacttgtacagtgccctatggctacaggttcagctcatgggcctttcgtgaagatcccggcccctacagaacaaccgccatcagtgtactccgcttccaattcacccctgagctggatatgcccttgcca

SEQ ID NO: 225 - DNA, 1449 bp, Nephrolepis exaltata
atggccgaagaggacccaatttttgcgcaattagcgcagaaaatggctgctgctgcagagaaggaggaggcccccgtagatcttcttgcgcaatacatgcaagtggaggctcatgactggcataaccggatcagaggcgccatattggggctgatatccgcagtgccgaaggtgggtgctgctataagcaggctcatcggcctcttttggccatcaaacaaggtggacatttgggaggccctcaacgcggaggagtatatcaggaacattgtccagcaggagcttttcgaattcgaaatgcagcttcttcagaacgacatccaagcgctggaaaccacggttgggagatacgatacggctgcacttactgaaaagggcaactttctaagcatctggatctcgcaagctgatgcgttgtatattcggatgcgaaactctaccaacaacatccaccttctccttcacatggtcaccgtgtctacacttcatctcgcagccctacatgagcgactcacatttggcgaggaactgtatggcacaaacaatgcagcgaattggacacaagatcttgtggataagttcgagaggtacacaaccgatttaatcccgaatgttttcagaaggtggaaggaatggaggccaacccagatcgagattacaacatgggtacgcaggggctcatgcggcaatcttacttgtagaccagacgtttcttatgctacagtggaggacaagatctccggggcattattctcattccaggcaacaaatcgaaactcgacaacaattttctcagaagtttgcgaagaccacaaaactcgaatggtgaacgaggccattgcggacatggcgagctgcctgtcacccacttttgctttccacaagctcctacccgacgatattcagacgcagttctctccttacgatcggcagcaatttggacaggttttcagaggcccatattcccaggatctttcgcacggactctggacggttttcaaatccttcagatcgcgcacaacacgctctgatcagacacttcgcgatagaatcttggaggtgatcataagagcggggcaccatgttgatgctatacagttcgtgtacgatcatgtgaatccaaattctacgactccggggattgtggctggaaatgccgcgggaggaactaggcatcagattgatgtgagggatcggcccataaaggaagtgcgcatggagttctctcaggatgtgcttgcttcgttgcagctccattttgaggatggcacatcaacacggaaattcggcaatgaacttggttgggcgactagaatactaacttgtacagtgccctatggctacaggttcagctcatgggcctttcgtgaagatcccggcccctacagaacaaccgccatcagtgtactccgcttccaattcacccctgagctggatatgcccttgcca

SEQ ID NO: 226 - DNA, 1449 bp, Nephrolepis exaltata
atggccgaagaggacccaatttttgcgcaattagcgcagaaaatggctgctgctgcagagaaggaggaggcccccgtagatcttcttgcgcaatacatgcaagtggaggctcatgactggcataaccggatcagaggcgccatattggggctgatatccgcagtgccgaaggtgggtgctgctataagcaggctcatcggcctcttttggccatcaaacaaggtggacatttgggaggccctcaacgcggaggagtatatcaggaacattgtccagcaggagcttttcgaattcgaaatgcagcttcttcagaacgacatccaagcgctggaaaccacggttgggagatacgatacggctgcacttactgaaaagggcaactttctaagcatctggatctcgcaagctgatgcgttgtatattcggatgcgaaactctaccaacaacatccaccttctccttcacatggtcaccgtgtctacacttcatctcgcagccctacatgagcgactcacatttggcgaggaactgtatggcacaaacaatgcagcgaattggacacaagatcttgtggataagttcgagaggtacacaaccgatttaatcccgaatgttttcagaaggtggaaggaatggaggccaacccagatcgagattacaacatgggtacgcaggggctcatgcggcaatcttacttgtagaccagacgtttcttatgctacagtggaggacaagatctccggggcattattctcattccaggcaacaaatcgaaactcgacaacaattttctcagaagtttgcgaagaccacaaaactcgaatggtgaacgaggccattgcggacatggcgagctgcctgtcacccacttttgctttccacaagctcctacccgacgatattcagacgcagttctctccttacgatcggcagcaatttggacaggttttcagaggcccatattcccaggatctttcgcacggactctgtacggttttcaaatccttcagatcgcgcacaacacgctctgatcagacacttcgcgatagaatcttggaggtgatcataagagcggggcaccatgttgatgctatacagttcgtgtacgatcatgtgaatccaaattctacgactccggggattgtggctggaaatgccgcgggaggaactaggcatcagattgatgtgagggatcggcccataaaggaagtgcgcatggagttctctcaggatgtgcttgcttcgttgcagctccattttgaggatggcacatcaacacggaaattcggcaatgaacttggttgggcgactagaatactaacttgtacagtgccctatggctacaggttcagctcatgggcctttcgtgaagatcccggcccctacagaacaaccgccatcagtgtactccgcttccaattcacccctgagctggatatgcccttgcca

SEQ ID NO: 227 - DNA, 1449 bp, Nephrolepis exaltata
atggccgaagaggacccaatttttgcgcaattagcgcagaaaatggctgctgctgcagagaaggaggaggcccccgtagatcttcttgcgcaatacatgcaagtggaggctcatgactggcataaccggatcagaggcgccatattggggctgatatccgcagtgccgaaggtgggtgctgctataagcaggctcatcggcctcttttggccatcaaacaaggtggacatttgggaggccctcaacgcggaggagtatatcaggaacattgtccagcaggagcttttcgaattcgaaatgcagcttcttcagaacgacatccaagcgctggaaaccacggttgggagatacgatacggctgcacttactgaaaagggcaactttctaagcatctggatctcgcaagctgatgcgttgtatattcggatgcgaaactctaccaacaacatccaccttctccttcacatggtcaccgtgtctacacttcatctcgcagccctacatgagcgactcacatttggcgaggaactgtatggcacaaacaatgcagcgaattggacacaagatcttgtggataagttcgagaggttcacaaccgatttaatcccgactgttttcagaaggtggaaggaatggaggccaacccagatcgagattacaacatgggtacgcaggggctcatgtggcaatcttacttgtagaccagacgtttcttatgctacagtggaggacaagatctccggggcattattctcattccaggcaacaaatcgaaactccacaacaattttctcagaagtctgcgaagaccacaaaactcgaatggtgaacgaggccattgcggacatggcgagctgcctgtcacccacttttgctttccacaagctcctacccgacgatattcagacgcagttctctccttacgatcggcagcaatttggacaggttttcagaggcccatattcccaggatctttcgcacggactctggacggttttcaaatccttcagatcgcgcacaacacgctctgatcagacacttcgcgatagaatcttggaggtgatcataagagcggggcaccatgttgatgctatacagttcgtgtacgatcatgtgaatccaaattctacgactccggggattgtggctggaaatgccgcgggaggaactaggcatcagattgatgtgagggatcggcccataaaggaagtgcgcatggagttctctcaggatgtgcttgcttcgttgcagctccattttgaggatggcacatcaacacggaaattcggcaatgaacttggttgggcgactagaatactaacttgtacagtgccctatggctacaggttcagctcatgggcctttcgtgaagatcctggcccctacagaacaaccgccatcagtgtactccgcttccaattcacccctgagctggatatgcccttgcca

SEQ ID NO: 228 - DNA, 1449 bp, Nephrolepis exaltata
atggccgaagaggacccaatttttgcgcaattagcgcagaagatggctgctgctgcagaaaaggaggaggtccccgtagatcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggaggaatatatcaggaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcatatcacccacttttgctctccacatgctcctacccgacgatgttaagacgcggttctctccttacgatcgggggctgttcggacgggtttccagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcaagatgtgcttgcttcgttgcagctccattttcaggatggtacatcaacacggaaattcggcaatgaacttggttgggcgactagaatactgacttgtacagcgccctatggctacaggttcagctcatgggcctttcgtgaagatcccggcccctacagaacaaccgccatcagtgtactccgcttccaattcacccccgagctggatatgcccttgcca

SEQ ID NO: 229 - DNA, 1551 bp, Hemionitis arifolia
atggcagctgaggacgttaaatctaccggatctgagcttgctactcccgctactgaggagctggcaccagctgctgcggttgtggacatgcaggaggccgaggaggacccaatttttgcgcagttagcgcaggagatgcaggtggctgctgcgaaggggcaggcggtagatctgatcgacgcattcatgcaagtgcaggctcacgactggcataaccgggtgagaggcgccatcctggggctcctatccttagtgcccaaggtggggggtgccatcagcaagctcatcggcctcttttggccggccaacaaggtggacatttgggaggccctcaagttggaggaatatgtgcggaacatagtccagcaggagatttttgacttcgaaatgcggttgcttcagtccgacatcgaagcgctggaaaccacgattgcaagatacgatatggctgcccttcctgagaagggaaattttttgagcatctggatctcacaagctgacgcattgtattttcgtatgcggaactctaccaataatattcaccttctccttcacattgtcaccgtgtctacgcttcatctcgcagccctgcatgagcgactaacatttggcgaggagctctatggtacaaacaatgcagcaaattggacacaagatcttgtcaatatgtttaggctatacacagttgagttgatcccaagtgtctttaaaaggtggaaggaatggagagaagcccaaatagagattcgagcatgggtaaacaggggcagctgcggcgttcttcagtgtagaccagatgtttctcatgctaccgtggaggataaaatctcaggggcgatattcaggtttcaggcaacgaaccgaaactcgacaacgattttctcagcaatttgcgaagatcacaaaactcggatggtgaatgaggccgtcgccgacatggccagctgcctgtcacccacgtttgcttttcacaagctcctaccggttaacattcagccgcagttccctgcgtttgatagggagcagttcgggcaggtattcagaggcccatattcgcaggatctgtcgcatggaacatggacgattctcaaatccttccgatcgcatccgacgcgcttcgatcatacggtgcgcgacagagtcttggagataaacataagagcggggcaccatgttgatgctatacgcttttggtacgaccatttaaacccaaattcaatgactgcgggaattatggctggaaacgcatcgggaggggttagccatcaggttgacatgaggggtcgcttcctacaggatttgcgcatggaattctctcaagacatacttgctgcattgcaactgcatttccacgatggcacatccacacggaaattcggcaacgagcttgggtgggcgtctcgaatcttaacttgtacagccccctacggctacaggctaagctcatgggccttccgccaagatgcaggcccctacggaacggccgccatcagtgtgctccgcttccaattcacccccgagctggactttcccgtgccagaagaatactcc

SEQ ID NO: 230 - DNA, 1551 bp, Hemionitis arifolia
atggcagctgaggacgttaaatctaccggatctgagcttgctactcccgctactgaggagctggcaccagctgctgcggttgtggacatgcaggaggccgaggaggacccaatttttgcgcagttagcgcaggagatgcaggcggctgctgcgaaggggcaggcggtagatctgatcgacgcattcatgcaagtgcaggctcacgactggcataaccgggtgagaggcgccatcctggggctcctatccttagtgcccaaggtggggggtgccatcagcaagctcatcggcctcttttggccggccaacaaggtggacatttgggaggccctcaagttggaggaatatgtgcggaacattgtccagcaggagatttttgacttcgaaatgcggttgcttcaggccgacatcgaagcgctggaaaccacgattacaagatacgatatggctgcccttcctgagaagggaaattttttgagcatctggatctcacaagctgacgcattgtattttcgtatgcggaactctaccaataatattcaccttctccttcacattgtcaccgtgtctacgcttcatctcgcagccctgcatgagcgactaacatttggcgaggagctctatggtacaaacaatgcagcaaattggacacaagatcttgtcaatatgtttaggctatacacagttgagttgatcccaagtgtctttaaaaggtggaaggaatggagagaagcccaaatagagattcgagcatgggtaaacaggggcagctgcggcgttcttcagtgtagaccagatgtttctcatgctaccgtggaggataaaatctcaggggcgatattcaggtttcaggcaacgaaccgaaactcgacaacgattttctcagcaatttgcgaagatcacaaaactcggatggtgaatgaggccgtcgccgacatggccagctgcctgtcacccacgtttgcttttcacaagctcctaccggttaacattcagccgcagttccctgcgtttgatagggagcagttcgggcaggtattcagaggcccatattcgcaggatctgtcgcatggaacatggacgattctcaaatccttccgatcgcatccgacgcgcttcgatcatacggtgcgcgacagagtcttggagataaacataagagcggggcaccatgttgatgctatacgcttttggtacgaccatttaaacccaaattcaatgactgcgggaattatggctggaaacgcatcgggaggggttagccatcaggttgacatgaggggtcgcttcctacaggatttgcgcatggaattctctcacgacatacttgctgcattgcaactgcatttccacgatggcacatccacacggaaattcggcaacgagcttgggtgggcgtctcgaatcttaacttgtacagccccctacggctacaggctaagctcatgggccttccgccaagatgcaggcccctacggaacggccgccatcagtgtgctccgcttccaattcacccccgagctggactttcccgtgccagaagaatactcc

SEQ ID NO: 231 - DNA, 1551 bp, Hemionitis arifolia
atggcagctgaggacgttaaatctaccggatctgagcttgctactcccgctactgaggagctggcaccagctgctgcggttgtggacatgcaggaggccgaggaggacccaatttttgcgcagttagcgcaggagatgcaggtggctgctgcgaaggggcaggcggtagatctgatcgacgcattcatgcaagtgcaggctcacgactggcataaccgggtgagaggcgccatcctggggctcctatccttagtgcccaaggtggggggtgccatcagcaagctcatcggcctcttttggccggccaacaaggtggacatttgggaggccctcaagttggaggaatatgtgcggaacattgtccagcaggagatttttgacttcgaaatgcggttgcttcaggccgacatcgaagcgctggaaaccacgattacaagatacgatatggctgcccttcctgagaagggaaattttttgagcatctggatctcacaagctgacgcattgtattttcgtatgcggaactctaccaataatattcaccttctccttcacattgtcaccgtgtctacgcttcatctcgcagccctgcatgagcgactaacatttggcgaggagctctatggtacaaacaatgcagcaaattggacacaagatcttgtcaatatgtttaggctatacacagttgagttgatcccaagtgtctttaaaaggtggaaggaatggagagaagcccaaatagagattcgagcatgggtaaacaggggcagctgcggcgttcttcagtgtagaccagatgtttctcatgctaccgtggaggataaaatctcaggggcgatattcaggtttcaggcaacgaaccgaaactcgacaacgattttctcagcaatttgcgaagatcacaaaactcggatggtgaatgaggccgtcgccgacatggccagctgcctgtcacccacgtttgcttttcacaagctcctaccggttaacattcagccgcagttccctgcgtttgatagggagcagttcgggcaggtattcagaggcccatattcgcaggatctgtcgcatggaacatggacgattctcaaatccttccgatcgcatccgacgcgcttcgatcatacggtgcgcgacagagtcttggagataaacataagagcggggcaccatgttgatgctatacgcttttggtacgaccatttaaacccaaattcaatgactgcgggaattatggctggaaacgcatcgggaggggttagccatcaggttgacatgaggggtcgcttcctacaggatttgcgcatggaattctctcacgacatacttgctgcattgcaactgcatttccacgatggcacatccacacggaaattcggcaacgagcttgggtgggcgtctcgaatcttaacttgtacagccccctacggctacaggctaagctcatgggccttccgccaagatgcaggcccctacggaacggccgccatcagtgtgctccgcttccaattcacccccgagctggactttcccgtgccagaagaatactcc

SEQ ID NO: 232 - DNA, 1551 bp, Hemionitis arifolia
atggcagctgaggacgttaaatctaccggatctgagcttgctactcccgctactgaggagctggcaccagctgctgcggctgtggacatgcaggaggccgaggaggacccaatttttgcgaagttagcgcaggagatgcaggtggctgctgcgaaggggcaggcggtagatctgatcgacgcatacatgcaagtggaggctcacgactggcataaccgggtgagaggcgccatcctggggctcatatccttagtgccgaaggtggggggtgccatcagcaagctcatcggcctcttttggccggccaacagggtggacatttgggaggccctcaagttggaggaatatgtgcggaacatagtccagcaggagatttttgacttcgaaatgcggttgcttcagtccgacatcgaagcgctggaaaccacgattgcaagatacgatatggctgcccttcctgagaagggaaattttttgagcatctggatctcacaagctgacgcattgtattttcgtatgcggaactctaccaataatattcaccttctccttcacattgtcaccgtgtctacgcttcatctcgcagccctgcatgagcgactaacatttggcgaggagctctatggtacaaacaatgcagcaaattggacacaagatcttgtcaatatgtttaggctatacacagttgagttgatcccaagtgtctttaaaaggtggaaggaatggagagaagcccaaatagagattcgagcatgggtaatcaggggcggctgcggcgttgttatgtgtagaccagatgtttctcatgctaccgttgaggataaaatctcaggggcgatattcaggtttcaggcaacgaaccgaaactcgacaacgattttctcagcaatttgcgaagatcacaaaactcggatggtgaatgaggccgtcgccgacatggccagctgcctgtcacccacgtttgcttttcacaagctcctaccggttaacattcagccgcagttccctgcgtttgatagggagcagttcgggcaggtattcagaggcccatattcgcaggatctgtcgcatggaacatggacgattctcaaatccttccgatcgcatccgacgcgcttcgatcatacggtgcgcgacagagtcttggagataaacataagagcggggcaccatgttgatgctatacgcttttggtacgaccatttaaacccaaattcaatgactgcgggaattatggctggaaacgcatcgggaggggttagccatcaggttgacatgaggggtcgcttcctacaggatttgcgcatggaattctctcaagacatacttgctgcattgcaactgcatttccacgatggcacatccacacggaaattcggcaacgagcttgggtgggcgtctcgaatcttaacttgtacagtcccctacggctacaggctaagctcatgggccttccgccaagatgcaggcccctacggaacggccgccatcagtgtgctccgcttccaattcacccccgagctggactttcccgtgccagaagaatactcc

SEQ ID NO: 233 - DNA, 1551 bp, Hemionitis arifolia
atggcagctgaggacgttaaatctaccggatctgagcttgctactcccgctactgaggagctggcaccagctgctgcggttgtggacatgcaggaggccgaggaggacccaatttttgcgcagttagcgcaggagatgcaggtggctgctgcgaaggggcaggcggtagatctgatcgacgcattcatgcaagtgcaggctcacgactggcataaccgggtgagaggcgccatcctggggctcctatccttagtgcccaaggtggggggtgccatcagcaagctcatcggcctcttttggccggccaacaaggtggacatttgggaggccctcaagttggaggaatatgtgcggaacattgtccagcaggagatttttgacttcgaaatgcggttgcttcaggccgacatcgaagcgctggaaaccacgattacaagatacgatatggctgcccttcctgagaagggaaattttttgagcatctggatctcacaagctgacgcattgtattttcgtatgcggaactctaccaataatattcaccttctccttcacattgtcaccgtgtctacgcttcatctcgcagccctgtatgagcgactaacatttggcgaggagctctatggtacaaacaatgcagcaaattggacacaagatcttgtcaatatgtttaggctatacacagttgagttgatcccaagtgtctttaaaaggtggaaggaatggagagaagcccaaatagagattcgagcatgggtaaacaggggcagctgcggcgttcttcagtgtagaccagatgtttctcatgctaccgtggaggataaaatctcaggggcgatattcaggtttcaggcaacgaaccgaaactcgacaacgattttctcagcaatttgcgaagatcacaaaactcggatggtgaatgaggccgtcgccgacatggccagctgcctgtcacccacgtttgcttttcacaagctcctaccggttaacattcagccgcagttccctgcgtttgatagggagcagttcgggcaggtattcagaggcccatattcgcaggatctgtcgcatggaacatggacgattctcaaatccttccgatcgcatccgacgcgcttcgatcatacggtgcgcgacagagtcttggagataaacataagagcggggcaccatgttgatgctatacgcttttggtacgaccatttaaacccaaattcaatgactgcgggaattatggctggaaacgcatcgggaggggttagccatcaggttgacatgaggggtcgcttcctacaggatttgcgcatggaattctctcaagacatacttgctgcattgcaactgcatttccacgatggcacatccacacggaaattcggcaacgagcttgggtgggcgtctcgaatcttaacttgtacagtcccctacggctacaggctaagctcatgggccttccgccaagatgcaggcccctacggaacggccgccatcagtgtgctccgcttccaattcacccccgagctggactttcccgtgccagaagaatactcc

SEQ ID NO: 234 - DNA, 1329 bp, Pteridium esculentum
atggtcgttgccagtgactggaacaatcggattagagataccgtcatgaagttgtcatccaaaatcccagaagtgggtgctgctgtaagcattctcataggcttcctctggccacaaaacaaggtcgatatttttgaggccctcaaggcagacgtgttaaagcttgtcaagaaacagatacttgactatgaactgaaccttcacaagtctgaaattgatgcgctaaaaattaccattgagagataccaggcggccaagcccaatgagaaggcttattttctcaataactggatcactgaggctgacaaattaagtgtcatctttcgccagtcgaccaacaacatccacctcatccttcccgttatcaccctggccctgcttcatcttagtggcctgcgggagagactggacttcggcaaggaactctatcacgaagacaatacaaaacagtgggaggaggatcttgaggagatgtataagacatacattgtgaacttcctccctgatgtcttcaaaaagtggaaagtctggagggcagaccaggtggagatcaatgcttggactgaaccacatccaacggcaattccccccttctttcgcatcgagtctcatgcaactgtggtcgataccattacaggtgagaagaaacatttctcagcagatctgacagattcaaagacaattttcgcaagtgtctgccaagaccataagactcgaatgtgcaatgatgcaactgctgacatggctggctgcatctcagccacatttgtgtttgataagctcttatcagacaacaagaagaatctgcccaagtatgacaagggcgtgtttggtcggatgttcagaggtccatattcccaagatctcttgttgtcagagcagaattttggcttcggcaacccggttaaaattttcagaacgcgtccagatcaggatgacaactcaccgagctcaggcccaatcaccaaggtgatcataagagagtggaacactgtcgatgccatgcaacttatctatgcgaaccgtcaagggcgtctagctggtaatgctggagggggacagaggcacgacatcgatgtgacaggcaagctcgtaagtggacttcacatgggattctctaatggagtgctcacttttgtccaacttctttactacgacggtacatcatcatctaaatatggaaaccgtagtggctggacatgttatgaagtctctgcaaacggcccccctgcctacagggtcagttcctggagctataaagaagacaggggcccatctaacacatatggccctagtgtaatccagctggaatacaccccacagattgaa

SEQ ID NO: 235 - DNA, 1329 bp, Pteridium esculentum
atggtcgttgccagtgactggaacaatcggattagagataccgtcatgaagttgtcatccaaaatcccagaagtgggtgctgctgtaagcattctcataggcttcctctggccacaaaacaaggtcgatatttttgaggccctcaaggcagacgtgttaaagcttgtcaagaaacagatacttgactatgaactgaaccttcacaagtctgaaattgatgcgctaaaaattaccattgagagataccaggcggccaagcccaatgagaaggcttattttctcaataactggatcactgaggctgacaaattaagtgtcatctttcgccagtcgaccaacaacatccacctcatccttcccgttatcaccctggccctgcttcatcttagtggcctgcgggagagactggacttcggcaaggaactctatcacgaagacaatacaaaacagtgggaggaggatcttgaggagatgtataagacatacattgtgaacttcctccctgatgtcttcaaaaagtggaaagtctggagggcagaccaggtggagatcaatgcttggactgaaccacatccaacggcaattccccccttctttcgcatcgagtctcatgcaactgtggtcgataccattacaggtgagaagaaacatttctcagcagatctgacagattcaaagacaattttcgcaagtgtctgccaagaccataagactcgaatgtgcaatgatgcaactgctgacatggctggctgcatctcagccacatttgtgtttgataagctcttatcagacaacaagaagaatctgcccaagtatgacaagggcgtgtttggtcggatgttcagaggtccatattcccaagatctcttgttgtcagagcagaattttggcttcggcaacccggttaaaattttcagaacgcgtccagatcaggatgacaactcaccgagctcaggcccaatcaccaaggtgatcataagagagtggaacactgtcgatgccatgcaacttatctatgcgaaccgtcaagggcgtctagctggtaatgctggagggggacagaggcacgacatcgatgtgacagacaagctcgtaagtggacttcacatgggattctctaatggagtgctcacttttgtccaacttctttactacgacggtacatcatcatctaaatatggaaaccgtagtggctggacatgttatgaagtctctgcaaacggcccccctgcctacagggtcagttcctggagctataaagaagacaggggcccatctaacacatatggccctagtgtaatccagctggaatacaccccacagattgaa

SEQ ID NO: 236 - DNA, 1533 bp, Pellaea falcata
atggcagctaagaatgatgtttctgagcttgctcccgctgctgatgacgaggtgcagaacgcagacgaggaggacccaattttctcgcaattagcgcagaagatggtcgctgctgcggaggcgggggaggtccccgtggtcgaccttcttgcccaatacaggcatgtggaggcgcacgactggcataaccggatcagaggcgccgtactcgctctgatagccttagtgccgaaggtgggcgctgccataagcaagctcgtcggcctcttttggcctgcaaaccgggtgaacatttgggaggccctgaatgcggagcaatatatcaggaacattgtccagcaggagatctttgaattcgaaatgcagctcctgcggagcgacatccaagcgctggaaaccactgttgcgagatacgatagggccgctgcgctcaatgagaaggggaatttcctaagcatctggatctcgcaagctgatgcactgtatagtcggatgcgaaactctgccaacaacatccaccttctccttcacatggtcaccgtgtctacgctacatctcgcagccctgcatgagcgaatgacatttggccaggaactctatggcacgaacaattcagcgaattggacgcaagatcttgtcgataagttcgcgctgtacacaaccgatttgatcccgagtgttttcaaaaggtggaaggactggaggccaacccaaatcgagattacagcttggacacgaccgggcagttgcagcaatgttatgggctgtggtccaaacatgtcttatgctagagtggaggataaggtctccggggcaatattcacgtttcaggcaaggaatcagctttcaacaacaattttctcaggaatttgtcaagatcacagaactcggatggtgaacgaggccattgctgacatggccagctgcctgtcacccacttttgcttttcacaggctcctacccgcctacattcagccgcggttctccgcttttgatagggagcagttcggacaggttttcagaggcccatattccgaggatctttcgcacggagcctggtttcatctcaaagccttcagatcgcacacaactcgctctgatcagacaaatcgcgatagaatcttgcaggtgatcataagagcggggcaccatgttgatgctatacagtttatgtatgatcatgcgaattcaaatgctctgactccagggattattgcgggaaactccgcaggagggaataggcatgaggtcaatgtgagggatccgcccatgcaggaattgcgcatggagttcgctcatgatgtgcttgcttcgttgcaaattcatttcgagggtggtacatcaacacggagatttggcaatgaacttggttgggcgtctagtatactaacttgtacagccccctatggctacaggttcagctcatttgcctttcgtgaagataccggcccctaccgaacaaccgccatcagtgtactccgcttccaattcacccccgagctggatattcccttgccagcgcaatatattata

SEQ ID NO: 237 - DNA, 1530 bp, Pellaea falcata
atggcagctaagaatgatgtttctgagcttgctcccgctgctgacgaggtgcagaacgcagacgaggagatggacccaatcttctcgcaattagcgcagaagatggtcgctgctgcggaggcgggggaggtccccgtggtcgaccttcttgcccaatacatgcaagtggaggcgcacgactggcataaccggatcagaggcgccgtactggggctgatatccgcagtgccgaaggtgggcgctgccataagcaggctcatcggcctcttttggcctgcaaacagggtggacatttgggaggccctgaatgcggaggagtatatcaggaacattgtccaacaggagctttttgaattcgagatgcagctcctgcggaacgacatcgaagcgctggaaaccactgttgcgagatacgatagggctgcgcttaatgagaaggggaatttcctaagcatctggatctcgcaagctgatgcactgtatattcggatgcgaaactctaccaacaacatccaccttctccttcacatggtcaccgtgtctacgctacatctcgcagccctgcatgagcgactgacatttggcgaggaactctatggcacaaacaattcagcgaattggacgcaagatctggtggataagttcgagctgtacacaaccgatttgatcccgagtgtttttaaaaggtggaaggactggaggccaacccaaatcgagattacagcctggacacgaaggggcacatgcagcaatgttacgggctgtaatccaaacttttcttatgctacagtagaggataaggtctccggagcaatattcacttttcaggcaaggaatcaactttcaacaacaattttctcagcagtttgtcaagatcacaaaactcggatggtgaatgaggccattgctgacatggccagctgcctgtcacccacttttgcttttcacaggctcctacccaacgacattcagccgcggttctctgcttatgatagggagcagttcggacaggttttcagaggcccatattcccaggatctttcgcacggagcctggatgaatcacaaagccttccgatcgcacacaactcgatctgatcagacaaatcgcgatagaatcttgcaggtgatcataagagcggggcaccatgttgatgctatacagtttatgtatgatcatgcgaattcaaatgctctgactccagggattattgctggaaactcggcgggagggattaggcatcaggtggatgtgagggatccgcccatgcaggaattgcgcatggagttctctcatgatgtgcttgcttcgttgcaaattcatttcgaggatggtacatcaacacggagatttggcaatgaacttggttgggcgactagaatactaacttgtacagccccctatggctacaggttcagctcatgggcctttcgtgaagatgccggcccctacggaacaaccgccatcagtgtactccgcttccaattcacccccgagctggatattcccttgccagcgcaatatattata

SEQ ID NO: 238 - DNA, 1530 bp, Pellaea falcata
atggcagctaagaatgatgtttctgagcttgctcccgctgcagctgacgaggtgcagaacgcagacgaggaggacccaattttctcgcaattagcgcagaagatggtcgctgctgcggaggcgggggaggtccccgtggtcgaccttcttgcccaatacatgcaagtggaggcgcacgactggcataaccggatcagaggcgccgtactcgctctgatagccttagtgccgaaggtgggcgctgccataagctggctcatcggcctcttttggccagcaaacagggtggacatttgggtggccctgaatgcggagcaatatatcaggaacattgtccatcaggagctctttgaattcgaaatgcagctcctgtggaacgacatcgaagcgctggaaaccactgttgcgagatacgatagggctgcgcttactgagaaggggaatttcctaagcatctggatctcgcaagctgatgcactgtttattcggatgcgaaactctgccaacaacatccaccttctccttcacatggtcaccgtgtctacgctacatctcgcagccctgcatgagcgactgacatttggcgaggaactctatggcacgaacaattcagcgaattggactcgagatcttgtggataagttcgagctgtacacaaccgatttgttcccgagtgtttttaaaaggtggaaggactggaggccaacccaaatcgagattacagcttggacacgaaggggctcatgcggcaatcttatctgtagaccaaacgtttcttatgctagagtggaggataaggtctccggggcaatattttcgtttcaggcaacgaatcaactttcaacaacaattttctcaggaatttgtcaagatcacaaaactcggatggtgaatgaggccattgcggacatggccagctgcctgtcacccacttttgcttttcacaggctcctacccgacgacattcagccgcggttctctgcttttgatagggagcaattcggacaggttttcagaggcccatattcccaggatctttcgcacggagcctggacgattctcaaagccttcagatcgcacacaactcgctctgatcagacaaatcgcgatagaatcttggagatgatcataagggcggggagccatgttgatgctatacagtttatgtacgatcatgccaatccaaatgctatgactgcagggattatggctggaaaccccacgggagggaataggcatcatgtcgatgtgaggggtcggcccattcgggaattgcgcatggcgttcgctcgtgacgtgatgtcttcgttgcaactccattttgaggatggtacagcaactcggagatttggcgatgaacatcaaagctgggcgtctagaatactaacttgtaccgtcccctatggctacaggctcagctcatgggcctttcgtgaagatcccggcccctaccgaacaaccgccatcagtgtactccgcttccaattcacccctgagctggatattcccttgccagcgcaatatattata

SEQ ID NO: 239 - DNA, 1452 bp, Ophioglossum pendulum
atggccgaagaggacccaatttttacacaattagcacagaagatggctgctgctgcagcgaaggaggaggtccccgtagatcttctcgcccagtacatgcaagtggaggctcatgactggcataaccgggtcagaggcgccatactggggctgatatccgcagtgccgaaggtgggtgctgccataagcaggctcatcggtctcttttggccagcaaacaaggtggacatttgggaggccctcaagttggaggaatatatcaggaacattgtccagcaggaactttttgagttcgaattgcggctccttgagaacgacatccaagcgctggaaaccactgttgggagatacgataccgctgcacttactgaaaaggggaactttctaagcatttggatctcgcaagctgatgcattgtatattcggatgcggaactctaccaacaacatccaccttctccttcacatggtcaccgtgtctacacttcatctcgcagctctgcatgagcgactgacatttggcgaggaactctatggcacaaacaattctgcaaattggacgcaagatctagtggacaagttcgagaggtacacaaccgatttaatcccgaatgttttcaagaggtggaaagaatggaggccaacccagatcgagattagagcatgggtacgcaggggctcgtgcggcaatcttacctgtagaccagacgtttcttatgccacagtggaggacaagatctccggggcattattctcatttcaggcaacaaatcgaaactcgacaacaattttcttagaagtttgcgaagaccacaaaactcggatggtgaacgaggccattgcggacatggcgagctgcctgtcacccacttttgccttccacaagctcctacccgacaatattcaggcgcagttctctccttacgatcggcagcagttcggacaggttctcagaggcccatattcccaggatctttcgcacggactgtggacggttttcaaatccttcagatcgcgcacaacacgctctgatcagacgcttcgcgatagaatcttggaggtgatcataagagcggggcaccatgttgatgctatacagttcgtgtacgatcatgcgaatccaaatcttacgacttcggggactgtggctggaaacgccacgggaggaagcaggcatcaggttgatgtgagggatcgacccatacaggaagtgcgcatggagttctcgcaggatgtgcttgcttcgttgcagctccactttgaggatggtacatcaacacggaaatttggcaatgaacttggttgggcgactagaatactaacttgtacagcgccctatggctacaggttcagctcatgggcctttcgtgaagatcccggcccctacagaacaaccgccatcagtgtactccgcttccaattcacccccgagctggatatgcccttgccaata

SEQ ID NO: 240 - DNA, 1452 bp, Ophioglossum pendulum
atggccgaagaggacccaatttttacacaattagcacagaagatggctgctgctgcagcgaaggaggaggtccccgtagatcttctcgcccagtacatgcaagtggaggctcatgactggcataaccgggtcagaggcgccatactggggctgatatccgcagtgccgaaggtgggtgctgccataagcaggctcatcggtctcttttggccagcaaacaaggtggacatttgggaggccctcaagttggaggaatatatcaggaacattgtccagcaggaactttttgagttcgaattgcggctccttgagaacgacatccgagcgctggaaaccactgttgggagatacgataccgctgcacttactgaaaaggggaactttctaagcatttggatctcgcaagctgatgcattgtatattcggatgcggaactctaccaacaacatccaccttctccttcacatggtcaccgtgtctacacttcatctcgcagctctgcatgagcgactgacatttggcgaggaactctatggcacaaacaattctgcaaattggacgcaagatctagtggacaagttcgagaggtacacaaccgatttaatcccgaatgttttcaagaggtggaaagaatggaggccaacccagatcgagattagagcatgggtacgcaggggctcgtgcggcaatcttacctgtagaccagacgtttcttatgccacagtggaggacaagatctccggggcattattctcatttcaggcaacaaatcgaaactcgacaacaattttcttagaagtttgcgaagaccacaaaactcggatggtgaacgaggccattgcggacatggcgagctgcctgtcacccacttttgccttccacaagctcctacccgacaatattcaggcgcagttctctccttacgatcggcagcagttcggacaggttctcagaggcccatattcccaggatctttcgcacggactgtggacggttttcaaatccttcagatcgcgcacaacacgctctgatcagacgcttcgcgatagaatcttggaggtgatcataagagcggggcaccatgttgatgctatacagttcgtgtacgatcatgcgaatccaaatcttacgacttcggggactgtggctggaaacgccacgggaggaagcaggcatcaggttgatgtgagggatcgacccatacaggaagtgcgcatggagttctcgcaggatgtgcttgcttcgttgcagctccactttgaggatggtacatcaacacggaaatttggcaatgaacttggttgggcgactagaatactaacttgtacagcgccctatggctacaggttcagctcatgggcctttcgtgaagatcccggcccctacagaacaaccgccatcagtgtactccgcttccaattcacccccgagctggatatgcccttgccaata

SEQ ID NO: 241 - DNA, 1458 bp, Selliguea feei
atgggtgccgacactgtggcaagtgattggaataaccggatcagagacgtcgtcatcaagctggctggaaagatcccagaagtgggttctgttgtaagtgttctaatcggcatgttttggccagaaaacaagatcaacgtttttgacgccctcaaggcagacttggcaaaactggtcaagaaagagatcctcgattacgaactgaacctgagtcagtctcagatcaacgggctaaaaattgtaattcagagatacaaggaggctaagaatcacgagaagggtgctctattaggcatttggattactcgggcggacgaattgagcgtacaatttcgagagtccaccaacaacattcacctcatccttcttgtcatcaacttggctgtgcttcatcttgcaggcctgcgggagaggctggacttcggcaaggagctctacaatgaagacaatacagaacaatggcggaaggatctcgagaaagtgtatagcacatatattgtggatttcctcccaaagatcttcaagcagtggcaagtgtggcgagcagatcagatccagattaaagcatggacagaaaagcatccagtcccccccttctttcggtctgagtcctatgcatcaacggaggatacaatcacaggggagaagaagaacttctatgtggatatgacaagctccttggaagtatttaaggagatttgcaatgcccataagactcgaatgtgcaacgatgcaagttcggacatggccggctgcatagcaaccacatttgagttctacaagatgttacctgagaacagcaagaatttccccaagtacgacaaggacgtgttcggtcggatgttcaaaggtccatactctgaagatctttactggccacagcggagctatggactaggcaattcagtttcaatcttcagagtgaatccgaatgaggacgactactcacccaattcgggcccgatcactaagatggtcataggagagtggaacagttttgatgcaaagcggcgtgtctactatgcaaatcgtgaagagatgcttgccgataatcctcgaggggggaaaaggcatgagattgacgtgacatatatgcccagaatagagtggtacagcaatgcaatgcagtttgtctatgcaaattgtaaagggaagcttgccggtaatcctcaaagaagaaaatggcatttcattgacgtgacaaacaagcccataaatggatttgtcctaggcttctctagcggagtgctcgtttctgtgcaaatcaattattatgatggttcatcgtcgtctacgtatggaaatagcaggggttggccaattaatgcagcatctccaaaaggccctcctgtctacaagctcagttcatggagctataaggaatataagcatagttctggcccttcaagaacgtgtggcccaagtgtagtccagctcgagtatgcgccgcagatcgaa

SEQ ID NO: 242 - DNA, 1338 bp, Selliguea feei
atgggtgccgacactgtggcaagtgattggaataaccggatcagagacgtcgtcatcaagctggctggaaagatcccagaagtgggttctgttgtaagtgttctaatcggcatgttttggccagaaaacaagatcaacgtttttgacgccctcaaggcagacttggcaaaactggtcaagaaagagatcctcgattacgaactgaacctgagtcagtctcagatcaacgggctaaaaattgtaattcagagatacaaggaggctaagaatcacgagaagggtgctctattaggcatttggattactcgggcggacgaattgagcgtacaatttcgagagtccaccaacaacattcacctcatccttcttgtcatcaacttggctgtgcttcatcttgcaggcctgcgggagaggctggacttcggcaaggagctctacaatgaagacaatacagaacaatggcggaaggatctcgagaaagtgtatagcacatacattgtggatttcctcccaaagatcttcaaacagtggaaagtgtggcgagcagatcagatccagattaaagcatggacagaagcgcatccaacagcgatcccccccttctttcggatggagtcctatgcatcaacagaggatacaatgacaggggagaagaagaacttctctgtggatttgacaagctccttggaagtctttaaggagatctgcaacgcccataagactcgaatgtgcaacgatgcgagttcggacatggccggctgcatagcaaccacatttgagttctacaagatgttacctaagaacagcaagaattttcccaagtacgacaaggacgtgtttgttcggatgttcaaaggtccatactctgaagatctttactggcaacaggagggctatggactaggcaacccagttccagtctttagagtgaatccggatcaagacgactactcacccaattcgggcccgatcactaagatggtcataagagagtggaacagtattgatgcaatgcagtttgtctatgcaaatcgtgaagggaagcttgccggtaatgcgcgagggggagaaaggcacgacattgacgtgacaaacaagcccataaatggacttgttctaggcttctctagtggagtgctcgcttctgtgaagatcaattattatgatggttcatcatcgtctacgtatggtaatcgcgggggttggcaaatttgtggagcatctccaaaaggccctcctgtctacaagctcagttcatggagctataaggaggattatggcccttcaggaacatatggcccaagtgtagtccagctggagtatgcgccgcagatcgaa

SEQ ID NO: 243 - DNA, 1458 bp, Selliguea feei
atgggtgccgacactgtggcaagtgactggaataaccggatcagagacgtggtcatcaagctggccggaaggatcccagaagtgggttctgctgtaagcgttctaatcggcatgttttggccagtaaacctgatcgacgtttttgaagccctcaaggcagacttgacaaatttgatcaagaaagagatcctagattacgaactgaacctgagtcagtctcagatcaaggggctaaaaattgtacttcagagatacaagggggctaagaatcacgagaagggtgctctattagacctttggatcactcaggctgaccaattgaacgtacaatttcgagagtctaccaacaacattcacctcatccttcttgtcatcaacgtggctgtgcttcatcttgcaggcctacgggagaggctggactttggcaaggagctctacaatgaagacaatacagaacaatggcgggaggatctcgagaaagtgtatagcacatatattgtggatttcctcccaaagatcttcaagcagtggcaagtgtggcgagcagatcagatccagattaaagcatggacagaaaagcatccagtcccccccttctttcggtctgagtcctatgcatcaacggaggatacaatcacaggggagaagaagaacttctatgtggatatgacaagctccttggaagtatttaaggagatttgcaatgcccataagactcgaatgtgcaacgatgcaagttcggacatggccggctgcatagcaaccacatttgagttctacaagatgttacctgagaacagcaagaatttccccaagtacgacaaggacgtgttcggtcggatgttcaaaggtccatactctgaagatctttactggccacagcggagctatggactaggcaattcagtttcaatcttcagagtgaatccgaatgaggacgactactcacccaattcgggcccgatcactaagatggtcataggagagtggaacagttttgatgcaaagcggcgtgtctactatgcaaatcgtgaagagatgcttgccgataatcctcgaggggggaaaaggcatgagattgacgtgacatatatgcccagaatagagtggtacagcaatgcaatgcagtttgtctatgcaaattgtaaagggaagcttgccggtaatcctcaaagaagaaaatggcatttcattgacgtgacaaacaagcccataaatggatttgtcctaggcttctctagcggagtgctcgtttctgtgcaaatcaattattatgatggttcatcgtcgtctacgtatggaaatagcaggggttggccaattaatgcagcatctccaaaaggccctcctgtctacaagctcagttcatggagctataaggaatataagcatagttctggcccttcaagaacgtgtggcccaagtgtagtccagctcgagtatgcgccgcagatcgaa

SEQ ID NO: 244 - DNA, 1338 bp, Selliguea feei
atgggtgccgacactgtggcaagtgattggaataaccggatcagagacgtcgtcatcaagctggctggaaagatcccagaagtgggttctgttgtaagtgttctaatcggcatgttttggtcagaaaacaagatcaacgtttttgacgccctcaaggcagacttggcaaaactggtcaagaaagagatcctcgattacgaactgaacctgagtcagtctcagatcaacgggctaaaaattgtaattcagagatacaaggaggctaagaatcacgagaagggtgctctattaggcatttggattactcgggcggacgaattgagcgtacaatttcgagagtccaccaacaacattcacctcatccttcttgtcatcaacttggctgtgcttcatcttgcaggcctgcgggagaggctggacttcggcaaggagctctacaatgaagacaatacagaacaatggcggaaggatctcgagaaagtgtatagcacatacattgtggatttcctcccaaagatcttcaaacagtggaaagtgtggcgagcagatcagatccagattaaagcatggacagaagcgcatccaacagcgatcccccccttctttcggatggagtcctatgcatcaacagaggatacaatgacaggggagaagaagaacttctctgtggatttgacaagctccttggaagtctttaaggagatctgcaacgcccataagactcgaatgtgcaacgatgcgagttcggacatggccggctgcatagcaaccacatttgagttctacaagatgttacctaagaacagcaagaattttcccaagtacgacaaggacgtgtttgttcggatgttcaaaggtccatactctgaagatctttactggcaacaggagggctatggactaggcaacccagttccagtctttagagtgaatccggatcaagacgactactcacccaattcgggcccgatcactaagatggtcataagagagtggaacagtattgatgcaatgcagtttgtctatgcaaatcgtgaagggaagcttgccggtaatgcgcgagggggagaaaggcacgacattgacgtgacaaacaagcccataaatggacttgttctaggcttctctagtggagtgctcgcttctgtgaagatcaattattatgatggttcatcatcgtctacgtatggtaatcgcgggggttggcaaatttgtggagcatctccaaaaggccctcctgtctacaagctcagttcatggagctataaggaggattatggcccttcaggaacatatggcccaagtgtagtccagctggagtatgcgccgcagatcgaa

SEQ ID NO: 245 - DNA, 1338 bp, Selliguea feei
atgggtgccgacactgtggcaagtgactggaataaccggatcagagatgtggtcatcaagctggctggaaagatcccagaagtggggtctgttgtaagtgttctaatcggcatgttttggccagaaaacaagatcaacgtttttgacggcctcaaggcagacttggcaaaactggtcaagaaagagatcctcgattacgaactgaacctgagtcagtctcagatcaatgggctaaaaattgtaattcagagatacaaggaggctaagaatcacgagaagggtgctctattaggcatttggatcacacgggccgaccaattgagtgtacaatttcgagagtctatcaacaacattcacctcatccttcttgtcatcaacctggctgtgcttcatcttgcaggcctacgggagaggctggactttggcaaggagctctacaatgaagacaatacagaacaatggcggaaggatctcgagaaagtgtatagcacatacattgtggatttcctcccaaaggtcttcaaactgtggaaagtgtggcgagcagatcagatccagattaaagcgtggacagaagcacacccaacagcaatccccccattctttcggttggagtcctacgcatcaacagaggatacaatcacaggggagaagaagaacttctctgtggatttgacaagctccttggaagtctttaagaagatttgcaacgcccataagactcgaatgtgcaacgatgcgagttcggacatggccggctgcatagcaaccacatttgagttctacaagatgttacccaagaacaacaagaatcttcccaagtacgacaaggacgtgtttggtcggatgttcaaaggtccatactctgaagatctttactggccacagcggggctatggactaggcaacccagttccagtctttagagtgaatccggataaggacgactactcacccaattcgggcccgatcactaagatggtcataagagagtggaacagtattgatgcaatgcagtttgtctatacaaatcgtgaagggaagcttgccggtaatccgcgagggggaaaaaggcacgacattgacgtgacaaacaagcccataaatggacttgtcctaggcttctctagtggagtgctcgcttctgtgaaaatcaattattatgatggttcatcatcgtccacgtatggaaatcgcgggggttggccaatttatgcagcatctccaaaaggccctcctgtccacaagctccgttcatggagctataaggaggattatggcccgtcaagaacgtatggcccaagtgtagtccagctggagtatgcgccgcagatcgaa

SEQ ID NO: 246 - DNA, 1464 bp, Polypodium glycyrrhiza
atgcaaatcgaggggaagagtctgcttactctaatcgcgctctctctctactctctctctacacacactctctctctctctctctctctaactacactctttttctcatggactcagaaatatatgatcgcagctccgccttcagctaaggatctgcaggacaatcaattagcagcacaagagaagatgactgctcatgacgacgatgacaataatacaatgaaggtttctgcgccgcctgttaataatattgctgctgctgctgcgccagctggtgataatgttgaggagctggatcagctgggggtagatgtgcttgccagaaacatgcaaatcgaggctcatgactggcaaaaccggcttagaaggtcgataatgacgctggcatccatgattccgaaggtgggcggtgccgtgagcctgctcattggcctcttttggccagcaaacaaggtggacatttgggaggccatcaatggggaggagtatgtgagaaacattgtccagcaggagatttttgaattcgaattgcagcaacttcggtcagacattgaggcgctggaagccactgtttcaagatacaatacggctgcgttaaccgagaaggggaatttcctaagcatctggatctcgcaagctgacgccctgagtattcgcatgcggaactctagcaacaacatccaccttctccttcaccttgtcaccgtggctgtgcttcatgtcgcagccctccacgaacgacttacatttggcgaggaactctacggctcaaaccatacagcaagttggacgcaagaccttgtgaatttgttccagctgtacacatccgacgtagtcccaaagctcttcagagagtggaggcagtggagggaaagccagattgagattaaagcatgggtagtaagaggcgcatggggcaaccttgttcaaaggccagacgtttctcatgctacagtggaggataagatctcaagggagatgttcacgtttcgggaaacgagacgaaactcgacaacaattttctcagatgtttgccaggatcacaaaactcggatgatgaatgaggccattgcggacatggccagctgcatgtcacccacgtttgcttttcacaagctcttacccgacgatattcagacgcagctccctccttacgataaggagctcttcgaacaagttttcagaggcccatattcgcaggatcttctgcaaaaactcttcacgactctcaaagctttcagatcacgaccaactcgcttcgaccagacggctcgcaacagaatcctggaggtggttgtaagagcggggcaccatgttgatgctatacaattttggtatgaccatgtgaattcaaatggtatgactgcagggactatggccggaaaccctagggggggagtaggtatttggctaacgtgagggatcggcccatacatgaattacgcatggagttctctcatgacg

SEQ ID NO: 247 - DNA, 1497 bp, Tectaria antioquoiana
atggcagcgcccggcatgaaggactccggagtgatcgctgacgtcgacgtagctactacggtttctgacgtgcctactaaggagctgcaggacttggatcaactggcgctgcaggacgtcagcaaaaacatagatgcgctcgccaaatacatgcaaatggaggctcacgactggcacaaccgggtgagaggcgctgtcctggggatcatagccgcaataccgaaggtgggtgctgccgtaagcaggctgatcggcctcttttggccaacgaacaaggttgatatctgggtggcgctcaacgcggaggaatacgttagaaacatcgtcaggcaggagatctttgaatttgaaatgcagcaacacaagtccgaaatcgaggccctggaagccgctatttccagatacgagagggctgcgattgctgagaaggggaactttctaagcatctggatctggcaagctgacagattgtgtattcagctgcgaaactctagcaacaacatccaccttctccttcacattgtcaccgtgtctgtgcttcatatcgccgccatgcatgagcgactagcatttggcgaggaaatctacggcacaaacaatacagcagcttggaggaaagactttgtagatgtgttccagatgtacacatccaatttgatcccaaatctcttcaagcagtggaggcagtggagggaaagccagattgagatcagagcatgggtagtaaggggtgtatggggcaatattactagcaccccagacgtttctcatgcaacagtggaggacaagatctcaggagagatattcaggtttcgggtagcgaggcgaaactcaacaacaattttctcagatgtttgccaagatcacagaactcggatgctaaatgaggcagttgcagacatggccgcctgcatttcacccacgtttggttttcacaagctcctacccaccgatatccaaacgcaatactctccttacgacaaggagctgttcgcgcaagtttttcgaggcccatattcacaggatcttttgcagccactcttcacgacactcaagaccttcagatcacgtccgactcgctttgatcaaacggctcgcgacagaatcttggagatgactatacgatcggggcaccatgtcgatgctatacaattttggtacgatcacgcgaattcaaatgctatgactgcagggattatgggcggaaactctacaggggggagcaggcatcaagttgatgtgaggaatcaacgcatacatgatttgcgcttggagttctctcacgacgtgcttgcttcgttgcaacttcatttcgaagatggtacatcaacacgaaaatttggcaatgaactgtggtgggcctctgacatagtaacttgtacaaccccctctggctacaggctcagctcatgggcctttcgtgaagatcccggcccctacaatacaaccgccatcagtttactccgcttccaattcacccatgatgatatctcatcc

SEQ ID NO: 248 - DNA, 1536 bp, Tectaria antioquoiana
atggcagcgcccggcatgaaggactccggagtgatcgctgacgtcgacgtagctactacggtttctgacgtgcctactaaggagctgcaggacttggatcaactggcgctgcaggacgtcagcaaaaacatagatgcgctcgccaaatacatgcaaatggaggctcacgactggcacaaccgggtgagaggcgctgtcctggggatcatagccgcaataccgaaggtgggtgctgccgtaagcaggctgatcggcctcttttggccaacgaacaaggttgatatctgggtggcgctcaacgcggaggaatacgttagaaacatcgtcaggcaggagatctttgaatttgaaatgcagcaacacaagtccgaaatcgaggccctggaagccgctatttccagatacgagagggctgcgattgctgagaaggggaactttctaagcatctggatctggcaagctgacagattgtgtattcagctgcgaaactctagcaacaacatccaccttctccttcacattgtcaccgtgtctgtgcttcatatcgccgccatgcatgagcgactagcatttggcgaggaaatctacggcacaaacaatacagcagcttggaggaaagactttgtagatgtgttccagatgtacacatccaatttgatcccaaatctcttcaagcagtggaggcagtggagggaaagccagattgagatcagagcatgggtagtaaggggtgtatggggcaatattactagcaccccagacgtttctcatgcaacagtggaggacaagatctcaggagagatattcaggtttcgggtagcgaggcgaaactcaacaacaattttctcagatgtttgccaagatcacagaactcggatgctaaatgaggcagttgcagacatggccgcctgcatttcacccacgtttggttttcacaagctcctacccaccgatatccaaacgcaatactctccttacgacaaggagctgttcgcgcaagtttttcgaggcccatattcacaggatcttttgcagccactcttcacgacactcaagaccttcagatcacgtccgactcgctttgatcaaacggctcgcgacagaatcttggagatgactatacgatcggggcaccatgtcgatgctatacaattttggtacgatcacgcgaattcaaatgctatgactgcagggattatgggcggaaactctacaggggggagcaggcatcaagttgatgtgaggaatcaacgcatacatgatttgcgcttggagttctctcacgacgtgcttgcttcgttgcaacttcatttcgaagatggtacatcaacacgaaaatttggcaatgaactgtggtgggcctctgacatagtaacttgtacaaccccctctggctacaggctcagctcatgggcctttcgtgaagatcccggcccctacaatacaaccgccatcagtttactccgcttccaattcacccctgatgatattcatcctaatctagacttgtccatcttctggattggccaacttaat

SEQ ID NO: 249 - DNA, 1497 bp, Tectaria antioquoiana
atggcagcgcccggcatgaaggactccggagtgatcgctgacgtcgacgtagctactacggtttctgacgtgcctactaaggagctgcaggacttggatcaactggcgctgcaggacgtcagcaaaaacatagatgcgctcgccaaatacatgcaaatggaggctcacgactggcacaaccgggtgagaggcgctgtcctggggatcatagccgcaataccgaaggtgggtgctgccgtaagcaggctgatcggcctcttttggccaacgaacaaggttgatatctgggtggcgctcaacgcggaggaatacgttagaaacatcgtcaggcaggagatctttgaatttgaaatgcagcaacacaagtccgaaatcgaggccctggaagccgctatttccagatacgagagggctgcgattgctgagaaggggaactttctaagcatctggatctggcaagctgacagattgtgtattcagctgcgaaactctagcaacaacatccaccttctccttcacattgtcaccgtgtctgtgcttcatatcgccgccatgcatgagcgactagcatttggcgaggaaatctacggcacaaacaatacagcagcttggaggaaagactttgtagatgtgttccagatgtacacatccaatttgatcccaaatctcttcaagcagtggaggcagtggagggaaagccagattgagatcagagcatgggtagtaaggggtgtatggggcaatattactagcaccccagacgtttctcatgcaacagtggaggacaagatctcaggagagatattcaggtttcgggtagcgaggcgaaactcaacaacaattttctcagatgtttgccaagatcacagaactcggatgctaaatgaggcagttgcagacatggccgcctgcatttcacccacgtttggttttcacaagctcctacccaccgatatccaaacgcaatactctccttacgacaaggagctgttcgcgcaagtttttcgagacccatattcacaggatcttttgcagccactcttcacgacactcaagaccttcagatcacgtccgactcgctttgatcaaacggctcgcgacagaatcttggagatgactatacgatcggggcaccatgtcgatgctatacaattttggtacgatcacgcgaattcaaatgctatgactgcagggattatgggcggaaactctacaggggggagcaggcatcaagttgatgtgaggaatcaacgcatacatgatttgcgcttggagttctctcacgacgtgcttgcttcgttgcaacttcatttcgaagatggtacatcaacacgaaaatttggcaatgaactgtggtgggcctctgacatagtaacttgtacaaccccctctggctacaggctcagctcatgggcctttcgtgaagatcccggcccctacaatacaaccgccatcagtttactccgcttccaattcacccctgatgatatctcatcc

SEQ ID NO: 250 - DNA, 1497 bp, Tectaria antioquoiana
atggcagcgcccggcatgaaggactccggagtgatcgctgacgtcgacgtagctactacggtttctgacgtgcctactaaggagctgcaggacttggatcaactggcgctgcaggacgtcagcaaaaacatagatgcgctcgccaaatacatgcaaatggaggctcacgactggcacaaccgggtgagaggcgctgtcctggggatcatagccgcaataccgaaggtgggtgctgccgtaagcaggctgatcggcctcttttggccaacgaacaaggttgatatctgggtggcgctcaacgcggaggaatacgttagaaacatcgtcaggcaggagatctttgaatttgaaatgcagcaacacaagtccgaaatcgaggccctggaagccgctatttccagatacgagagggctgcgattgctgagaaggggaactttctaagcatctggatctggcaagctgacagattgtgtattcagctgcgaaactctagcaacaacatccaccttctccttcacattgtcaccgtgtctgtgcttcatatcgccgccatgcatgagcgactagcatttggcgaggaaatctacggcacaaacaatacagcagcttggaggaaagactttgtagatgtgttccagatgtacacatccaatttgatcccaaatctcttcaagcagtggaggcagtggagggaaagccagattgagatcatagcatgggtagtaaggggtgtatggggcaatattactagcaccccagacgtttctcatgcaacagtggaggacaagatctcaggagagatattcaggtttcgggtagcgaggcgaaactcaacaacaattttctcagatgtttgccaagatcacagaactcggatgctaaatgaggcagttgcagacatggccgcctgcatttcacccacgtttggttttcacaagctcctacccaccgatatccaaacgcaatactctccttacgacaaggagctgttcgcgcaagtttttcgaggcccatattcacaggatcttttgcagccactcttcacgacactcaagaccttcagatcacgtccgactcgctttgatcaaacggctcgcgacagaatcttggagatgactatacgatcggggcaccatgtcgatgctatacaattttggtacgatcacgcgaattcaaatgctatgactgcagggattatgggcggaaactctacaggggggagcaggcatcaagttgatgtgaggaatcaacgcatacatgatttgcgcttggagttctctcacgacgtgcttgcttcgttgcaacttcatttcgaagatggtacatcaacacgaaaatttggcaatgaactgtggtgggcctctgacatagtaacttgtacaaccccctctggctacaggctcagctcatgggcctttcgtgaagatcccggcccctacaatacaaccgccatcagtttactccgcttccaattcacccctgatgatatctcatcc

SEQ ID NO: 251 - DNA, 1362 bp, Nephrolepis cordifolia
atgggctctgagaagctccatgttgccactgagatagtcattggtgactggaataatcggattagagataccattatgaagatatcatcgaaaatcccagaagtgggtgtggttgtgagcactctcattggcttcttctggccagaaaacaaggtggacatttttgaggccctcaaggtggacataacaaagcttgttaagaaagaggtgctcgactacgaagtgaacctacatcactctgagatcaatgcgctaaaaactatcatgggcagatacaagggggctaagatgcatgagaagggtaattttctgagcaactggatcactgaggctgacaaattgagtgtcatctttcgagagtccgccaatagcattcacctcatccttccggtcatcaccctggctctgcttcatctcacaggcctgcgggagagactcgactttggcagggaactctatggtgaagacaatacaagacagtggaagcaggatcttgaggagatgtacaagacatacattgtggattttctcccaaataccttcaaaaaatggaaagtgtggagggcaaaccaggtggagattaacgggtggaccgaaacgcacccaacagcaattccccccttctttcggaaagagtctcacgcaacagttgtggatactattacaggtgagaagaagcactactccgtggatctgacagagtcgaagtcaattttccagagagtctgcgaagaccataagaccaagatgtgcaatgaggctgccgcagacatggccggctgcatatcagcctcattcatgttctacaagctcttacctgctgacagcaataagaatttccccaaatatgacaaggcagtgtttggtcggatcttcagaggtccatattccgaggatcttttctcttcagatcgaaattttggattcggctacccagttccggtttttagaacacgtccgaattatgacgactactcgcccaattcgggcccaatcaccaaggtgattgtacgagagtggaacactattgatgccatgcaattcgtctatgcaaaccgtcaaggtaatctggctggtaatgcgcgcgggggacagaggcatgagatcgatgtgacgggcaagcccataggcggacttcgcatggggttctctaatggagtgctcacttatgtccaaatcatttatcttgatggtacattctcatccacatttgggaaccgcagcggttgggcatgtcatgaagcatctccaaaatgcccctctgcctacagggtcagctcatggagctataaggtcgatagcggcccgtcaaacacatctggccctagtacaatccagttggagtatgcgccgcagatggaa

SEQ ID NO: 252 - DNA, 1362 bp, Nephrolepis cordifolia
atgggctctgagaagctccatgttgccactgagatagtcattggtgactggaataatcggattagagataccattatgaagatatcatcgaaaatcccagaagtgggtgtggttgtgagcactctcattggcttcttctggccagaaaacaaggtggacatttttgaggccctcaaggcggacataacaaagctcgttaagaaagaggtgctcgactacgaagtgaacctacatcactctgagatcaatgcgctaaaaactatcatgggcagatacaagggggctaagatgcatgagaagggtaattttctgagcaactggatcactgaggctgacaaattgagtgtcatctttcgagagtccgccaatagcattcacctcatccttccggtcatcaccctggctctgcttcatctcacaggcctgcgggagagactcgactttggcagggaactctatggtgaagacaatacaagacagtggaagcaggatcttgaggagatgtacaagacatacattgtggattttctcccaaataccttcaaaaaatggaaagtgtggagggcaaaccaggtggagattaacgggtggaccgaaacgcacccaacagcaattccccccttctttcggaaagagtctcacgcaacagttgtggatactattacaggtgagaagaagcactactccgtggatctgacagagtcgaagtcaattttccagagagtctgcgaagaccataagaccaagatgtgcaatgaggctgccgcagacatggccggctgcatatcagcctcattcatgttctacaagctcttacctgctgacagcaataagaatttccccaaatatgacaaggcagtgtttggtcggatcttcagaggtccatattccgaggatcttttctcttcagatcgaaattttggattcggctacccagttccggtttttagaacacgtccgaattatgacgactactcgcccaattcgggcccaatcaccaaggtgattgtacgagagtggaacactattgatgccatgcaattcgtctatgcaaaccgtcaaggtaatctggctggtaatgcgcgcgggggacagaggcatgagatcgatgtgacgggcaagcccataggcggacttcgcatggggttctctaatggagtgctcacttatgtccaaatcatttatcttgatggtacattctcatccacatttgggaaccgcagcggttgggcatgtcatgaagcatctccaaaatgcccctctgcctacagggtcagctcatggagctataaggtcgatagcggcccgtcaaacacatctggccctagtacaatccagttggagtatgcgccgcagatggaa

SEQ ID NO: 253 - protein, 531 aa, Artificial Sequence
  IPD113 chimeric protein
MDSDLIAQPPDDNAASVGAPAAEKVQEDQLVVTTPEMEDSDVDPQFEQEMINISALIAAGAVEGHDDVDLFAKYMQVEAHDWHNRVRGAILGLISAVPKVGAAISRLIGLFWPANKVDIWEALRAEEYIRNIVQQELFEFEMRLLENDIQALETTVGRYDTAALTEKGNFLSIWISQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCLSPTFAFHKLLPDDIQTQFSPYDRQQFGQVFRGPYSQDLSHGLWTAFKNFRSRTTRSDQTLRDRILEVIIRAGHHVDAIQFVYDHSNPNLTTPGTVAGNAAGGTRHQVDVRDRPIQELRMEFSQDVLASLQLHFEDGTSTRKFGNELGWATRILTCTAPYGYRFSSWAFREDPGPYRTTAISVLRFQFTPELDMPLPASYMLS

SEQ ID NO: 254 - protein, 507 aa, Artificial Sequence
  IPD113 chimeric protein
MAAEGVETVSELAPATDKVQNADMAEEDPIFTQLAQKMAAAAEKEEVPVDLLAQYMQVEAHDWQNRLRQAILGLTLAIPNPIVGLAISGFIRLLWPANKVSIWEALNAEQYITNIVQQELMQFEMRTLQSRIEALQTTIHRYDQAAATTEKGNFLSNWITQADGLLSSMRNSSNRIHLLLHIVTVAALHMAALHERLTFGEELYGLNDTASWQRALVEMFEEYTIKLIPTIFKEWRPWRERQIEINEWRQRGQSGVTIFRPDSSHATVQDKLSGELFTFRVNYQYSTTIFSGVTRDHRTRMINEAIADMASCISPTFALHMLLPDDVKTRFSPYDRGLFGRVSRGPYSQDLLQQLFTSVKDFRSHPRRFDQTARDRVVKVIIRAGHHVDAIQFWYDHVNSNSTTTGIMAGNSSGGIRHEIDVKDRPIHELRMEFSHNVLASLQLHFQDGTATQKFGNVNGWASRIATCTAPYSYKLSSWAFREDPGPYNTTAISVLRFDFTPEDPSS

SEQ ID NO: 255 - protein, 533 aa, Artificial Sequence
  IPD113 chimeric protein
MDSDLIAQPPDDNAASVGAPAAEKVQEDQLVVTTPEMEDSDVDPQFEQEMINISALIAAGAVEGHDDVDLFAKYMQVEAHDWQNRLRQAILGLTLAIPNPIVGLAISGFIRLLWPANKVSIWEALNAEQYITNIVQQELFEFEMRLLENDIQALETTVGRYDTAALTEKGNFLSIWISQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCLSPTFAFHKLLPDDIQTQFSPYDRQQFGQVFRGPYSQDLSHGLWTAFKNFRSRTTRSDQTLRDRILEVIIRAGHHVDAIQFVYDHSNPNLTTPGTVAGNAAGGTRHQVDVRDRPIQELRMEFSQDVLASLQLHFEDGTSTRKFGNELGWATRILTCTAPYGYRFSSWAFREDPGPYRTTAISVLRFQFTPELDMPLPASYMLS

SEQ ID NO: 256 - protein, 505 aa, Artificial Sequence
  IPD113 chimeric protein
MAAEGVETVSELAPATDKVQNADMAEEDPIFTQLAQKMAAAAEKEEVPVDLLAQYMQVEAHDWHNRVRGAILGLISAVPKVGAAISRLIGLFWPANKVDIWEALRAEEYIRNIVQQELMQFEMRTLQSRIEALQTTIHRYDQAAATTEKGNFLSNWITQADGLLSSMRNSSNRIHLLLHIVTVAALHMAALHERLTFGEELYGLNDTASWQRALVEMFEEYTIKLIPTIFKEWRPWRERQIEINEWRQRGQSGVTIFRPDSSHATVQDKLSGELFTFRVNYQYSTTIFSGVTRDHRTRMINEAIADMASCISPTFALHMLLPDDVKTRFSPYDRGLFGRVSRGPYSQDLLQQLFTSVKDFRSHPRRFDQTARDRVVKVIIRAGHHVDAIQFWYDHVNSNSTTTGIMAGNSSGGIRHEIDVKDRPIHELRMEFSHNVLASLQLHFQDGTATQKFGNVNGWASRIATCTAPYSYKLSSWAFREDPGPYNTTAISVLRFDFTPEDPSS

SEQ ID NO: 257 - protein, 534 aa, Artificial Sequence
  IPD113 chimeric protein
MDSDLIAQPPDDNAASVGAPAAEKVQEDQLVVTTPEMEDSDVDPQFEQEMINISALIAAGAVEGHDDVDLFAKYMQVEAHDWQNRLRQAILGLTLAIPNPIVGLAISGFIRLLWPANKVSIWEALNAEQYITNIVQQELMQFEMRTLQSRIEALQTTIHRYDQAAATTEKGNFLSNWITQADGLLSSMRNSSNRIHLLLHIVTVAALHMAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCLSPTFAFHKLLPDDIQTQFSPYDRQQFGQVFRGPYSQDLSHGLWTAFKNFRSRTTRSDQTLRDRILEVIIRAGHHVDAIQFVYDHSNPNLTTPGTVAGNAAGGTRHQVDVRDRPIQELRMEFSQDVLASLQLHFEDGTSTRKFGNELGWATRILTCTAPYGYRFSSWAFREDPGPYRTTAISVLRFQFTPELDMPLPASYMLS

SEQ ID NO: 258 - protein, 504 aa, Artificial Sequence
  IPD113 chimeric protein
MAAEGVETVSELAPATDKVQNADMAEEDPIFTQLAQKMAAAAEKEEVPVDLLAQYMQVEAHDWHNRVRGAILGLISAVPKVGAAISRLIGLFWPANKVDIWEALRAEEYIRNIVQQELFEFEMRLLENDIQALETTVGRYDTAALTEKGNFLSIWISQADALYIRMRNSTNNIHLLLHMVTVSTLHLAALHERLTFGEELYGLNDTASWQRALVEMFEEYTIKLIPTIFKEWRPWRERQIEINEWRQRGQSGVTIFRPDSSHATVQDKLSGELFTFRVNYQYSTTIFSGVTRDHRTRMINEAIADMASCISPTFALHMLLPDDVKTRFSPYDRGLFGRVSRGPYSQDLLQQLFTSVKDFRSHPRRFDQTARDRVVKVIIRAGHHVDAIQFWYDHVNSNSTTTGIMAGNSSGGIRHEIDVKDRPIHELRMEFSHNVLASLQLHFQDGTATQKFGNVNGWASRIATCTAPYSYKLSSWAFREDPGPYNTTAISVLRFDFTPEDPSS

SEQ ID NO: 259 - protein, 534 aa, Artificial Sequence
  IPD113 chimeric protein
MDSDLIAQPPDDNAASVGAPAAEKVQEDQLVVTTPEMEDSDVDPQFEQEMINISALIAAGAVEGHDDVDLFAKYMQVEAHDWQNRLRQAILGLTLAIPNPIVGLAISGFIRLLWPANKVSIWEALNAEQYITNIVQQELMQFEMRTLQSRIEALQTTIHRYDQAAATTEKGNFLSNWITQADGLLSSMRNSSNRIHLLLHIVTVAALHMAALHERLTFGEELYGLNDTASWQRALVEMFEEYTIKLIPTIFKEWRPWRERQIEINEWRQRGQSGVTIFRPDSSHATVQDKLSGELFTFRVNYQYSTTIFSGVTRDHRTRMINEAIADMASCISPTFALHMLLPDDVKTRFSPYDRGLFGRVSRGPYSQDLSHGLWTAFKNFRSRTTRSDQTLRDRILEVIIRAGHHVDAIQFVYDHSNPNLTTPGTVAGNAAGGTRHQVDVRDRPIQELRMEFSQDVLASLQLHFEDGTSTRKFGNELGWATRILTCTAPYGYRFSSWAFREDPGPYRTTAISVLRFQFTPELDMPLPASYMLS

SEQ ID NO: 260 - protein, 504 aa, Artificial Sequence
  IPD113 chimeric protein
MAAEGVETVSELAPATDKVQNADMAEEDPIFTQLAQKMAAAAEKEEVPVDLLAQYMQVEAHDWHNRVRGAILGLISAVPKVGAAISRLIGLFWPANKVDIWEALRAEEYIRNIVQQELFEFEMRLLENDIQALETTVGRYDTAALTEKGNFLSIWISQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCLSPTFAFHKLLPDDIQTQFSPYDRQQFGQVFRGPYSQDLLQQLFTSVKDFRSHPRRFDQTARDRVVKVIIRAGHHVDAIQFWYDHVNSNSTTTGIMAGNSSGGIRHEIDVKDRPIHELRMEFSHNVLASLQLHFQDGTATQKFGNVNGWASRIATCTAPYSYKLSSWAFREDPGPYNTTAISVLRFDFTPEDPSS

SEQ ID NO: 261 - protein, 534 aa, Artificial Sequence
  IPD113 chimeric protein
MDSDLIAQPPDDNAASVGAPAAEKVQEDQLVVTTPEMEDSDVDPQFEQEMINISALIAAGAVEGHDDVDLFAKYMQVEAHDWQNRLRQAILGLTLAIPNPIVGLAISGFIRLLWPANKVSIWEALNAEQYITNIVQQELMQFEMRTLQSRIEALQTTIHRYDQAAATTEKGNFLSNWITQADGLLSSMRNSSNRIHLLLHIVTVAALHMAALHERLTFGEELYGLNDTASWQRALVEMFEEYTIKLIPTIFKEWRPWRERQIEINEWRQRGQSGVTIFRPDSSHATVQDKLSGELFTFRVNYQYSTTIFSGVTRDHRTRMINEAIADMASCISPTFALHMLLPDDVKTRFSPYDRGLFGRVSRGPYSQDLLQQLFTSVKDFRSHPRRFDQTARDRVVKVIIRAGHHVDAIQFVYDHSNPNLTTPGTVAGNAAGGTRHQVDVRDRPIQELRMEFSQDVLASLQLHFEDGTSTRKFGNELGWATRILTCTAPYGYRFSSWAFREDPGPYRTTAISVLRFQFTPELDMPLPASYMLS

SEQ ID NO: 262 - protein, 504 aa, Artificial Sequence
  IPD113 chimeric protein
MAAEGVETVSELAPATDKVQNADMAEEDPIFTQLAQKMAAAAEKEEVPVDLLAQYMQVEAHDWHNRVRGAILGLISAVPKVGAAISRLIGLFWPANKVDIWEALRAEEYIRNIVQQELFEFEMRLLENDIQALETTVGRYDTAALTEKGNFLSIWISQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCLSPTFAFHKLLPDDIQTQFSPYDRQQFGQVFRGPYSQDLSHGLWTAFKNFRSRTTRSDQTLRDRILEVIIRAGHHVDAIQFWYDHVNSNSTTTGIMAGNSSGGIRHEIDVKDRPIHELRMEFSHNVLASLQLHFQDGTATQKFGNVNGWASRIATCTAPYSYKLSSWAFREDPGPYNTTAISVLRFDFTPEDPSS

SEQ ID NO: 263 - protein, 512 aa, Artificial Sequence
  IPD113 chimeric protein
MAAEGVETVSELAPATDKVQNADMAEEDPIFTQLAQKMAAAAEKEEVPVDLLAQYMQVEAHDWHNRVRGAILGLISAVPKVGAAISRLIGLFWPANKVDIWEALRAEEYIRNIVQQELFEFEMRLLENDIQALETTVGRYDTAALTEKGNFLSIWISQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCLSPTFAFHKLLPDDVKTRFSPYDRGLFGRVFRGPYSQDLSHGLWTAFKNFRSRTTRSDQTLRDRILEVIIRAGHHVDAIQFVYDHSNPNLTTPGTVAGNAAGGTRHQVDVRDRPIQELRMEFSQDVLASLQLHFQDGTATQKFGNVNGWASRIATCTAPYSYKLSSWAFREDPGPYRTTAISVLRFQFTPELDMPLPASYMLS

SEQ ID NO: 264 - protein, 513 aa, Artificial Sequence
  IPD113 chimeric protein
MAAEGVETVSELAPATDKVQNADMAEEDPIFTQLAQKMAAAAEKEEVPVDLLAQYMQVEAHDWHNRVRGAILGLISAVPKVGAAISRLIGLFWPANKVDIWEALRAEEYIRNIVQQELMQFEMRTLQSRIEALQTTIHRYDQAAATTEKGNFLSNWITQADGLLSSMRNSSNRIHLLLHIVTVAALHMAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCLSPTFAFHMLLPDDVKTRFSPYDRGLFGRVSRGPYSQDLLQQLFTSVKDFRSHPRRFDQTARDRVVKVIIRAGHHVDAIQFWYDHVNSNSTTTGIMAGNSSGGIRHEIDVKDRPIHELRMEFSHNVLASLQLHFQDGTATQKFGNELGWATRILTCTAPYGYRFSSWAFREDPGPYNTTAISVLRFQFTPELDMPLPASYMLS

SEQ ID NO: 265 - protein, 512 aa, Artificial Sequence
  IPD113 chimeric protein
MAAEGVETVSELAPATDKVQNADMAEEDPIFTQLAQKMAAAAEKEEVPVDLLAQYMQVEAHDWHNRVRGAILGLISAVPKVGAAISRLIGLFWPANKVDIWEALNAEQYITNIVQQELMQFEMRTLQSRIEALQTTIHRYDQAALTEKGNFLSIWISQADALYIRMRNSTNNIHLLLHMVTVSTLHLAALHERLTFGEELYGTNNSTNWTRDLVDKFETYTSDLIPNVFKRWRPWRERQIEINEWRQRGQSGVTIFRPDSSHATVEDKISGALFSFQATNRNSTTLFLEVCEDHKTRMVNEAIADMASCLSPTFALHMLLPDDVKTRFSPYDRGLCGRVSRGPYSQDLSHGLWTAFKNFRSRTTRSDQTLRDRILEVIIRAGHHVDAIQFVYDHSNPNLTTPGTVAGNAAGGTRHQVDVRDRPIQELRMEFSQDVLASLQLHFEDGTSTRKFGNELGWATRILTCTAPYGYRFSSWAFREDPGPYNTTAISVLRFQFTPELDMPLPASYMLS

SEQ ID NO: 266 - protein, 512 aa, Artificial Sequence
  IPD113 chimeric protein
MAAEGVETVSELAPATDKVQNADMAEEDPIFTQLAQKMAAAAEKEEVPVDLLAQYMQVEAHDRHNRVRGAILGLISAVPKVGAAISRLIGLFWPANKVSIWEALRAEEYIRNIVQQELFEFEMRLLENDIQALETTVGRYDTAALTEKGNFLSIWISQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHRTRMVNEAIADMASCLSPTFALHMLLPDDVKTRFSPYDRGLFGRVSRGPYSQDLLQQLFTSVKDFRSHPRRFDQTARDRVVKVIIRAGHHVDAIQFWYDHVNPNLTTPGTVAGNAAGGTRHEIDVKDRPIQELRMEFSQDVLASLQLHFEDGTSTRKFGNELGWATRILTCTAPYGYRFSSWAFREDPGPYRTTAISVLRFQFTPELDMPLPASYMLS

SEQ ID NO: 267 - protein, 532 aa, Artificial Sequence
  IPD113 chimeric protein
MDSDLIAQPPDDNAASVGAPAAEKVQEDQLVVTTPEMEDSDVDPQFEQEMINISALIAAGAVEGHDDVDLLAQYMQVEAHDWHNRVRGAILGLISAVPKVGAAISRLIGLFWPANKVDIWEALRAEEYIRNIVQQELFEFEMRTLQSRIEALQTTIHRYDQAAATTEKGNFLSNWITQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHRTRMINEAIADMASCISPTFALHMLLPDDVKTRFSPYDRGLFGRVSRGPYSQDLSHGLWTAFKNFRSRTTRSDQTLRDRILEVIIRAGHHVDAIQFVYDHSNPNLTTPGTVAGNAAGGTRHQVDVRDRPIQELRMEFSQDVLASLQLHFEDGTATQKFGNELGWATRILTCTAPYGYRFSSWAFREDPGPYRTTAISVLRFDFTPELDMPLPASYMLS

SEQ ID NO: 268 - protein, 512 aa, Artificial Sequence
  IPD113 chimeric protein
MAAEGVETVSELAPATDKVQNADMAEEDPIFTQLAQKMAAAAEKEEVPVDLLAQYMQVEAHDWHNRVRGAILGLISAVPKVGAAISRLIGLFWPANKVDIWEALRAEEYIRNIVQQELFEFEMRLLENDIQALETTVGRYDTAALTEKGNFLSIWISQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCLSPTFALHMLLPDDVKTRFSPYDRGLFGRVSRGPYSQDLLQQLFTSVKDFRSHPRRFDQTARDRVVKVIIRAGHHVDAIQFVYDHSNPNLTTPGTVAGNAAGGTRHQVDVRDRPIQELRMEFSQDVLASLQLHFQDGTSTRKFGNELGWATRILTCTAPYGYRFSSWAFREDPGPYRTTAISVLRFDFTPELDMPLPASYMLS

SEQ ID NO: 269 - protein, 513 aa, Artificial Sequence
  IPD113 chimeric protein
MAAEGVETVSELAPATDKVQNADMAEEDPIFTQLAQKMAAAAEKEEVPVGLLAQYMQVEAHDWHNRVRGAILGLISAVPKVGAAISRLIGLFWPANKVDIWEALRAEQYITNIVQQELMQFEMRTLQSRIEALQTTIHRYDQAAATTEKGNFLSNWITQADGLLSSMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCLSPTFAFHKLLPDDIQTQFSPYDRQQFGQVFRGPYSQDLSHGLWTAFKNFRSRTTRSDQTLRDRILEVIIRAGHHVDAIQFVYDHSNPNLTTPGTVAGNAAGGTRHQVDVRDRPIQELRMEFSQDVLASLQLHFEDGTSTRKFGNELGWATRILTCTAPYGYRFSSWAFREDPGPYNTTAISVLRFQFTPELDMPLPASYMLS

SEQ ID NO: 270 - protein, 512 aa, Artificial Sequence
  IPD113 chimeric protein
MAAEGVETVSELAPATDKVQNADMAEEDPIFTQLAQKMAAAAEKEEVPVDLLAQYMQVEAHDWHNRVRGAILGLISAVPKVGAAISRLIGLFWPANKVDIWEALRAEEYIRNIVQQELFEFEMRLLENDIQALETTVGRYDTAALTEKGNFLSIWISQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCISPTFALHMLLPDDVKTRFSPYDRGLFGRVSRGPYSQDLSHGLWTAFKNFRSRTTRSDQTLRDRILEVIIRAGHHVDAIQFVYDHSNPNLTTPGTVAGNAAGGTRHQVDVRDRPIQELRMEFSQDVLASLQLHFQDGTSTRKFGNELGWATRILTCTAPYGYRFSSWAFREDPGPYRTTAISVLRFQFTPELDMPLPASYMLS

SEQ ID NO: 271 - protein, 512 aa, Artificial Sequence
  IPD113 chimeric protein
MAAEGVETVSELAPATDKVQNADMAEEDPIFTQLAQKMAAAAEKEEVPVDLLAQCMQVEAHDWHNRVRGAILGLISAVPKVGAAISRLIGLFWPANKVDIWEALRAEEYIRNIVQQELFEFEMRLLENDIQALETTVGRYDTAALTEKGNFLSIWISQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCLSPTFAFHMLLPDDVKTRFSPYDRGLFGRVSRGPYSQDLLQQLFTSVKDFRSHPRRFDQTARDRVVKVIIRAGHHVDAIQFVYDHSNPNLTTPGTVAGNAAGGTRHQVDVRDRPIHELRMEFSHNVLASLQLHFQDGTSTRKFGNVNGWATRILTCTAPYGYRFSSWAFREDPGPYRTTAISVLRFQFTPELDMPLPASYMLS

SEQ ID NO: 272 - protein, 512 aa, Artificial Sequence
  IPD113 chimeric protein
MAAEGVETVSELAPATDKVQNADMAEEDPIFTQLAQKMAAAAEKEEVPVDLLAQYMQVEAHDWHNRVRGAILGLISAVPKVGAAISRLIGLFWPANKVSIWEALRAEEYIRNIVQQELFEFEMRLLENDIQALETTVGRYDTAALTEKGNFLSIWISQADALYIRMRNSTNNIHLLLHMVTVSTLHLAALHERLTFGEELYGTNNSTNWTRDLVDKFETYTSDLIPNVFKRWRPWRERQIEINEWRQRGQSGVTIFRPDSSHATVQDKLSGELFTFRVNYQYSTTIFSGVTRDHKTRMVNEAIADMASCLSPTFAFHKLLPDDVKTRFSPYDRGLFGRVSRGPYSQDLSHGLWTAFKNFRSRTTRSDQTLRDRILEVIIRAGHHVDAIQFVYDHSNPNLTTPGTVAGNAAGGTRHQVDVRDRPIQELRMEFSQDVLASLQLHFEDGTSTRKFGNELGWATRILTCTAPYGYKLSSWAFREDPGPYRTTAISVLRFDFTPELDMPLPASYMLS

SEQ ID NO: 273 - protein, 515 aa, Artificial Sequence
  IPD113 chimeric protein
MAAEGVETVSELAPATDKVQNADMAEEDPIFTQLAQKMAAAAEKEEVPVDLLAQYMQVEAHDWQNRLRQAILGLTLAIPNPIVGLAISGFIRLLWPANKVSIWEALNAEQYITNIVQQELMQFEMRTLQSRIEALQTTIHRYDQAAATTEKGNFLSNWITQADGLLSSMRNSSNRIHLLLHIVTVAALHMAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCLSPTFAFHKLLPDDIQTQFSPYDRQQFGRVFRGPYSQDLSHGLWTAFKNFRSRTTRSDQTLRDRILEVIIRAGHHVDAIQFWYDHVNSNSTTTGIMAGNAAGGTRHQVDVRDRPIQELRMEFSQDVLASLQLHFEDGTSTRKFGNELGWATRILTCTAPYGYRFSSWAFREDPGPYNTTAISVLRFDFTPELDMPLPASYMLS

SEQ ID NO: 274 - protein, 515 aa, Artificial Sequence
  IPD113 chimeric protein
MAAEGVETVSELAPATDKVQNADMAEEDPIFTQLAQKMAAAAEKEEVPVDLLAQYMQVEAHDWQNRLRQAILGLTLAIPNPIVGLAISGFIRLLWPANKVDIWEALNAEQYITNIVQQELMQFEMRTLQSRIEALQTTIHRYDQAAATTEKGNFLSIWISQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCLSPTFAFHKLLPDDIQTQFSPYDRQQFGQVFRGPYSQDLSHGLWTAFKNFRSRTTRSDQTLRDRILEVIIRAGHHVDAIQFVYDHSNPNLTTPGTVAGNAAGGTRHQVDVRDRPIQELRMEFSQDVLASLQLHFEDGTSTRKFGNELGWATRILTCTAPYGYRFSSWAFREDPGPYNTTAISVLRFDFTPELDMPLPASYMLS

SEQ ID NO: 275 - protein, 512 aa, Artificial Sequence
  IPD113 chimeric protein
MAAEGVETVSELAPATDKVQNADMAEEDPIFTQLAQKMAAAAEKEEVPVDLLAKYMQVEAHDWHNRVRGAILGLISAVPKVGAAISRLIGLFWPANKVSIWEALRAEEYITNIVQQELFEFEMRLLENDIQALETTVGRYDTAALTEKGNFLSIWISQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCLSPTFAFHKLLPDDVKTRFSPYDRGLFGRVSRGPYSQDLLQQLFTSVKDFRSHPRRFDQTARDRVVKVIIRAGHHVDAIQFVYDHSNPNLTTPGTVAGNAAGGTRHQVDVRDRPIQELRMEFSHNVLASLQLHFEDGTSTRKFGNELGWATRILTCTAPYGYRFSSWAFREDPGPYRTTAISVLRFQFTPELDMPLPASYMLS

SEQ ID NO: 276 - protein, 515 aa, Artificial Sequence
  IPD113 chimeric protein
MAAEGVETVSELAPATDKVQNADMAEEDPIFTQLAQKMAAAAEKEEVPVDLLAQYMQVEAHDWHNRVRGAILGLTLAIPNPIVGLAISGFIRLLWPANKVSIWEALNAEQYITNIVQQELMQFEMRTLQSRIEALQTTIHRYDQAAATTEKGNFLSNWITQADGLLSSMRNSSNRIHLLLHIVTVAALHMAALHERLTFGEELYGLNDTASWQRALVEMFEEYTIKLIPTIFKEWRPWRERQIEINEWRQRGQSGVTIFRPDSSHATVQDKLSGELFTFRVNYQYSTTIFSGVTRDHKTRMINEAIADMASCISPTFAFHKLLPDDIQTQFSPYDRQQFGQVFGGPYSQDLSHGLWTAFKNFRSRTTRSDQTLRDRILEVIIRAGHHVDAIQFWYDHVNSNSTTTGIMAGNSSGGIRHEIDVKDRPIHELRMEFSHNVLASLQLHFQDGTATQKFGNVNGWASRIATCTAPYGYRFSSWAFREDPGPYRTTAISVLRFQFTPELDMPLPASYMLS

SEQ ID NO: 277 - protein, 512 aa, Artificial Sequence
  IPD113 chimeric protein
MAAEGVETVSELAPATDKVQNADMAEEDPIFTQLAQKMAAAAEKEEVPVDLLAQYMQVEAHDWHNRVRGAILGLISAVPKVGAAISRLIGLFWPANKVDIWEALRAEEYIRNIVQQELFEFEMRLLENDIQALETTVGRYDTAALTEKGNFLSIWISQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCLSPTFAFHKLLPDDVKTRFSPYDRGLFGRVSRGPYSQDLLQQLFTSVKDFRSHPRRFDQTARDRVVKVIIRAGHHVDAIQFVYDHSNPNLTTPGTVAGNAAGGTRHQVDVRDRPIHELRMEFSHNVLASLQLHFQDGTATQKFGNVNGWATRILTCTAPYGYRFSSWAFREDPGPYRTTAISVLRFQFTPELDMPLPASYMLS

SEQ ID NO: 278 - protein, 512 aa, Artificial Sequence
  IPD113 chimeric protein
MAAEGVETVSELAPATDKVQNADMAEEDPIFTQLAQKMAAAAEKEEVPVDLLAQYMQVEAHDWHNRVRGAILGLISAVPKVGAAISRLIGLLWPANKVDIWEALRAEEYIRNIVQQELFEFEMRLLENDIQALETTVGRYDTAALTEKGNFLSIWISQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKLSGALFSFQATNRNSTTLFLEVCEDHKTRMVNEAIADMASCISPTFALHKLLPDDVKTRFSPYDRGLFGRVSRGPYSQDLSHGLWTAFKNFRSRTTRSDQTLRDRILEVIIRAGHHVDAIQFVYDHSNPNLTTPGTVAGNAAGGTRHQVDVRDRPIQELRMEFSQDVLASLQLHFEDGTSTRKFGNELGWATRILTCTAPYGYKLSSWAFREDPGPYRTTAISVLRFDFTPELDMPLPASYMLS

SEQ ID NO: 279 - protein, 512 aa, Artificial Sequence
  IPD113 chimeric protein
MAAEGVETVSELAPATDKVQNADMAEEDPIFTQLAQKMAAAAEKEEVPVDLLAQYMQVEAHDWHNRVRGAILGLISAVPKVGAAISRLIGLFWPANKVDIWEALRAEEYIRNIVQQELFEFEMRLLENDIQALETTVGRYDTAALTEKGNFLSIWISQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCLSPTFAFHMLLPDDIQTQFSPYDRGLFGRVSRGPYSQDLSHGLWTAFKNFRSRTTRSDQTLRDRILEVIIRAGHHVDAIQFVYDHSNPNLTTPGTVAGNAAGGTRHQVDVRDRPIQELRMEFSHNVLASLQLHFEDGTSTRKFGNELGWASRIATCTAPYSYKLSSWAFREDPGPYRTTAISVLRFQFTPELDMPLPASYMLS

SEQ ID NO: 280 - protein, 512 aa, Artificial Sequence
  IPD113 chimeric protein
MAAEGVETVSELAPATDKVQNADMAEEDPIFTQLAQKMAAAAEKEEVPVDLLAQYMQVEAHDWHNRVRGAILGLISAVPKVGAAISRLIGLFWPANKVDIWEALRAEEYIRNIVQQELFEFEMRLLENDIQALETTVGRYDTAALTEKGNFLSIWISQADALYIRMRNSTNNIHLLLHMVTVSTLHLAALHERLTFGEELYGTNNSTNWTRDLVDKFETYTSDLIPNVFKRWKEWRPTQIEISAWVRRGSCGNLTCRPDVSYATVEDKISGALFSFQATNRNSTTLFLEVCEDHKTRMVNEAIADMASCISPTFALHMLLPDDIQTQFSPYDRGLFGRVSRGPYSQDLSHGLWTAFKNFRSRTTRSDQTLRDRILEVIIRAGHHVDAIQFVYDHSNPNLTTPGTVAGNAAGGTRHQVDVRDRPIQELRMEFSQDVLASLQLHFEDGTATQKFGNVNGWATRILTCTAPYGYRFSSWAFREDPGPYRTTAISVLRFQFTPELDMPLPASYMLS

SEQ ID NO: 281 - protein, 512 aa, Artificial Sequence
  IPD113 chimeric protein
MAAEGVETVSELAPATDKVQNADMAEEDPIFTQLAQKMAAAAEKEEVPVDLLAQYMQVEAHDWHNRVRGAILGLISAVPKVGAAISRLIGLFWPANKVDIWEALRAEEYIRNIVQQELFEFEMRLLENDIQALETTVGRYDTAALTEKGNFLSIWISQADALYIRMRNSTNNIHLLLHMVTVSTLHLAALHERLTFGEELYGLNDTASWQRALVEMFEEYTIKLIPTIFKEWRPWRERQIEINEWRQRGQSGVTIFRPDSSHATVQDKLSGELFTFRVNYQYSTTIFSGVTRDHRTRMINEAIADMASCISPTFALHMLLPDDIQTQFSPYDRQQFGRVSRGPYSQDLLQQLFTSVKDFRSHPRRFDQTARDRVVKVIIRAGHHVDAIQFWYDHVNSNSTTTGIMAGNSSGGIRHEIDVRDRPIQELRMEFSHNVLASLQLHFEDGTSTRKFGNELGWATRILTCTAPYGYRFSSWAFREDPGPYNTTAISVLRFDFTPELDMPLPASYMLS

SEQ ID NO: 282 - DNA, 1593 bp, Artificial Sequence
  coding sequence for IPD113 chimeric protein
atggattccgatctgattgctcagcctcctgacgataacgctgcttctgtgggtgccccggctgcagagaaggttcaggaggatcagttggtagtgacaacgccagaaatggaggactcagacgttgatccgcaattcgaacaagaaatgatcaatatttctgcgcttatcgctgctggtgcagtggaggggcacgacgacgtagatcttttcgccaaatacatgcaggtcgaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggaggaatatatcaggaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcctgtcacccacttttgctttccacaagctcctacccgacgatattcagacgcagttctctccttacgatcggcagcagttcggacaggttttcagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcaagatgtgcttgcttcgttgcagctccattttgaggatggtacatcaacacggaaattcggcaatgaacttggttgggcgactagaatactgacttgtacagcgccctatggctacaggttcagctcatgggcctttcgtgaagatcccggcccctacagaacaaccgccatcagtgtactccgcttccaattcacccccgagctggatatgcccttgccagcatcttatatgctctca

SEQ ID NO: 283 - DNA, 1521 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcagaaccggcttagacaagctatactggggctaacgcttgcaatcccaaacccaattgtgggtttagcgataagtgggttcatccgcctcctttggccagcaaacaaggtaagtatttgggaggctctcaatgcggagcaatacattacgaacattgtccagcaggagctgatgcaattcgaaatgcggacacttcagtcccgaatcgaggcgctgcaaaccacaattcacagatacgatcaggccgctgcaactactgagaaggggaactttctaagtaactggatcactcaagctgatggtttgctttctagcatgcgcaattcttccaacaggatccaccttctccttcacattgtcaccgtggctgcgctccatatggcagctctgcatgagcgactgacttttggcgaggaactctacggcttaaacgatacagcaagttggcagcgagctctggtggaaatgtttgaggagtacacgatcaaattaatcccgaccatctttaaggagtggaggccgtggcgggaacgccagattgagattaacgaatggagacagaggggtcaatcgggcgtaactatatttcgtccagactcttcccatgctaccgtgcaggataagctctcaggggaacttttcacatttcgggtgaactatcaatactcgacaacaattttctctggagtgaccagagatcataggactcggatgattaatgaggcaattgcggacatggctagctgcatatcacccacttttgctctccacatgctcctacctgatgatgtcaagacacggttttctccttatgacagggggttattcggccgggtgagcagaggcccatattctcaggatcttcttcagcaacttttcacgagtgtgaaagacttcagatcgcatccaagacgctttgatcagacggctcgtgaccgagtcgtgaaggtgattataagagcgggtcaccacgttgatgctatacaattttggtacgatcatgtgaattcaaattctacaactacaggcattatggctggaaattctagtggggggattaggcatgagattgacgtgaaggaccggcccatacacgagttgcgcatggagttttctcacaacgtgctcgcttcattgcaacttcatttccaagatggtacagcaacgcaaaaatttggcaatgtaaatggttgggcatctagaatagccacttgcacagccccctatagctacaagcttagctcatgggcctttcgtgaagatcccggcccctataatacgacagccatcagtgtacttcgcttcgatttcacacctgaagatccctcatca

SEQ ID NO: 284 - DNA, 1599 bp, Artificial Sequence
  coding sequence for IPD113 chimeric protein
atggattccgatctgattgctcagcctcctgacgataacgctgcttctgtgggtgccccggctgcagagaaggttcaggaggatcagttggtagtgacaacgccagaaatggaggactcagacgttgatccgcaattcgaacaagaaatgatcaatatttctgcgcttatcgctgctggtgcagtggaggggcacgacgacgtagatcttttcgccaaatacatgcaggtcgaggctcatgactggcagaaccggcttagacaagctatactggggctaacgcttgcaatcccaaacccaattgtgggtttagcgataagtgggttcatccgcctcctttggccagcaaacaaggtaagtatttgggaggctctcaatgcggagcaatacattacgaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcctgtcacccacttttgctttccacaagctcctacccgacgatattcagacgcagttctctccttacgatcggcagcagttcggacaggttttcagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcaagatgtgcttgcttcgttgcagctccattttgaggatggtacatcaacacggaaattcggcaatgaacttggttgggcgactagaatactgacttgtacagcgccctatggctacaggttcagctcatgggcctttcgtgaagatcccggcccctacagaacaaccgccatcagtgtactccgcttccaattcacccccgagctggatatgcccttgccagcatcttatatgctctca

SEQ ID NO: 285 - DNA, 1515 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggaggaatatatcaggaacattgtccagcaggagctgatgcaattcgaaatgcggacacttcagtcccgaatcgaggcgctgcaaaccacaattcacagatacgatcaggccgctgcaactactgagaaggggaactttctaagtaactggatcactcaagctgatggtttgctttctagcatgcgcaattcttccaacaggatccaccttctccttcacattgtcaccgtggctgcgctccatatggcagctctgcatgagcgactgacttttggcgaggaactctacggcttaaacgatacagcaagttggcagcgagctctggtggaaatgtttgaggagtacacgatcaaattaatcccgaccatctttaaggagtggaggccgtggcgggaacgccagattgagattaacgaatggagacagaggggtcaatcgggcgtaactatatttcgtccagactcttcccatgctaccgtgcaggataagctctcaggggaacttttcacatttcgggtgaactatcaatactcgacaacaattttctctggagtgaccagagatcataggactcggatgattaatgaggcaattgcggacatggctagctgcatatcacccacttttgctctccacatgctcctacctgatgatgtcaagacacggttttctccttatgacagggggttattcggccgggtgagcagaggcccatattctcaggatcttcttcagcaacttttcacgagtgtgaaagacttcagatcgcatccaagacgctttgatcagacggctcgtgaccgagtcgtgaaggtgattataagagcgggtcaccacgttgatgctatacaattttggtacgatcatgtgaattcaaattctacaactacaggcattatggctggaaattctagtggggggattaggcatgagattgacgtgaaggaccggcccatacacgagttgcgcatggagttttctcacaacgtgctcgcttcattgcaacttcatttccaagatggtacagcaacgcaaaaatttggcaatgtaaatggttgggcatctagaatagccacttgcacagccccctatagctacaagcttagctcatgggcctttcgtgaagatcccggcccctataatacgacagccatcagtgtacttcgcttcgatttcacacctgaagatccctcatca

SEQ ID NO: 286 - DNA, 1602 bp, Artificial Sequence
  coding sequence for IPD113 chimeric protein
atggattccgatctgattgctcagcctcctgacgataacgctgcttctgtgggtgccccggctgcagagaaggttcaggaggatcagttggtagtgacaacgccagaaatggaggactcagacgttgatccgcaattcgaacaagaaatgatcaatatttctgcgcttatcgctgctggtgcagtggaggggcacgacgacgtagatcttttcgccaaatacatgcaggtcgaggctcatgactggcagaaccggcttagacaagctatactggggctaacgcttgcaatcccaaacccaattgtgggtttagcgataagtgggttcatccgcctcctttggccagcaaacaaggtaagtatttgggaggctctcaatgcggagcaatacattacgaacattgtccagcaggagctgatgcaattcgaaatgcggacacttcagtcccgaatcgaggcgctgcaaaccacaattcacagatacgatcaggccgctgcaactactgagaaggggaactttctaagtaactggatcactcaagctgatggtttgctttctagcatgcgcaattcttccaacaggatccaccttctccttcacattgtcaccgtggctgcgctccatatggcagctctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcctgtcacccacttttgctttccacaagctcctacccgacgatattcagacgcagttctctccttacgatcggcagcagttcggacaggttttcagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcaagatgtgcttgcttcgttgcagctccattttgaggatggtacatcaacacggaaattcggcaatgaacttggttgggcgactagaatactgacttgtacagcgccctatggctacaggttcagctcatgggcctttcgtgaagatcccggcccctacagaacaaccgccatcagtgtactccgcttccaattcacccccgagctggatatgcccttgccagcatcttatatgctctca

SEQ ID NO: 287 - DNA, 1512 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggaggaatatatcaggaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacttttggcgaggaactctacggcttaaacgatacagcaagttggcagcgagctctggtggaaatgtttgaggagtacacgatcaaattaatcccgaccatctttaaggagtggaggccgtggcgggaacgccagattgagattaacgaatggagacagaggggtcaatcgggcgtaactatatttcgtccagactcttcccatgctaccgtgcaggataagctctcaggggaacttttcacatttcgggtgaactatcaatactcgacaacaattttctctggagtgaccagagatcataggactcggatgattaatgaggcaattgcggacatggctagctgcatatcacccacttttgctctccacatgctcctacctgatgatgtcaagacacggttttctccttatgacagggggttattcggccgggtgagcagaggcccatattctcaggatcttcttcagcaacttttcacgagtgtgaaagacttcagatcgcatccaagacgctttgatcagacggctcgtgaccgagtcgtgaaggtgattataagagcgggtcaccacgttgatgctatacaattttggtacgatcatgtgaattcaaattctacaactacaggcattatggctggaaattctagtggggggattaggcatgagattgacgtgaaggaccggcccatacacgagttgcgcatggagttttctcacaacgtgctcgcttcattgcaacttcatttccaagatggtacagcaacgcaaaaatttggcaatgtaaatggttgggcatctagaatagccacttgcacagccccctatagctacaagcttagctcatgggcctttcgtgaagatcccggcccctataatacgacagccatcagtgtacttcgcttcgatttcacacctgaagatccctcatca

SEQ ID NO: 288 - DNA, 1602 bp, Artificial Sequence
  coding sequence for IPD113 chimeric protein
atggattccgatctgattgctcagcctcctgacgataacgctgcttctgtgggtgccccggctgcagagaaggttcaggaggatcagttggtagtgacaacgccagaaatggaggactcagacgttgatccgcaattcgaacaagaaatgatcaatatttctgcgcttatcgctgctggtgcagtggaggggcacgacgacgtagatcttttcgccaaatacatgcaggtcgaggctcatgactggcagaaccggcttagacaagctatactggggctaacgcttgcaatcccaaacccaattgtgggtttagcgataagtgggttcatccgcctcctttggccagcaaacaaggtaagtatttgggaggctctcaatgcggagcaatacattacgaacattgtccagcaggagctgatgcaattcgaaatgcggacacttcagtcccgaatcgaggcgctgcaaaccacaattcacagatacgatcaggccgctgcaactactgagaaggggaactttctaagtaactggatcactcaagctgatggtttgctttctagcatgcgcaattcttccaacaggatccaccttctccttcacattgtcaccgtggctgcgctccatatggcagctctgcatgagcgactgacttttggcgaggaactctacggcttaaacgatacagcaagttggcagcgagctctggtggaaatgtttgaggagtacacgatcaaattaatcccgaccatctttaaggagtggaggccgtggcgggaacgccagattgagattaacgaatggagacagaggggtcaatcgggcgtaactatatttcgtccagactcttcccatgctaccgtgcaggataagctctcaggggaacttttcacatttcgggtgaactatcaatactcgacaacaattttctctggagtgaccagagatcataggactcggatgattaatgaggcaattgcggacatggctagctgcatatcacccacttttgctctccacatgctcctacctgatgatgtcaagacacggttttctccttatgacagggggttattcggccgggtgagcagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcaagatgtgcttgcttcgttgcagctccattttgaggatggtacatcaacacggaaattcggcaatgaacttggttgggcgactagaatactgacttgtacagcgccctatggctacaggttcagctcatgggcctttcgtgaagatcccggcccctacagaacaaccgccatcagtgtactccgcttccaattcacccccgagctggatatgcccttgccagcatcttatatgctctca

SEQ ID NO: 289 - DNA, 1512 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggaggaatatatcaggaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcctgtcacccacttttgctttccacaagctcctacccgacgatattcagacgcagttctctccttacgatcggcagcagttcggacaggttttcagaggcccatattctcaggatcttcttcagcaacttttcacgagtgtgaaagacttcagatcgcatccaagacgctttgatcagacggctcgtgaccgagtcgtgaaggtgattataagagcgggtcaccacgttgatgctatacaattttggtacgatcatgtgaattcaaattctacaactacaggcattatggctggaaattctagtggggggattaggcatgagattgacgtgaaggaccggcccatacacgagttgcgcatggagttttctcacaacgtgctcgcttcattgcaacttcatttccaagatggtacagcaacgcaaaaatttggcaatgtaaatggttgggcatctagaatagccacttgcacagccccctatagctacaagcttagctcatgggcctttcgtgaagatcccggcccctataatacgacagccatcagtgtacttcgcttcgatttcacacctgaagatccctcatca

SEQ ID NO: 290 - DNA, 1602 bp, Artificial Sequence
  coding sequence for IPD113 chimeric protein
atggattccgatctgattgctcagcctcctgacgataacgctgcttctgtgggtgccccggctgcagagaaggttcaggaggatcagttggtagtgacaacgccagaaatggaggactcagacgttgatccgcaattcgaacaagaaatgatcaatatttctgcgcttatcgctgctggtgcagtggaggggcacgacgacgtagatcttttcgccaaatacatgcaggtcgaggctcatgactggcagaaccggcttagacaagctatactggggctaacgcttgcaatcccaaacccaattgtgggtttagcgataagtgggttcatccgcctcctttggccagcaaacaaggtaagtatttgggaggctctcaatgcggagcaatacattacgaacattgtccagcaggagctgatgcaattcgaaatgcggacacttcagtcccgaatcgaggcgctgcaaaccacaattcacagatacgatcaggccgctgcaactactgagaaggggaactttctaagtaactggatcactcaagctgatggtttgctttctagcatgcgcaattcttccaacaggatccaccttctccttcacattgtcaccgtggctgcgctccatatggcagctctgcatgagcgactgacttttggcgaggaactctacggcttaaacgatacagcaagttggcagcgagctctggtggaaatgtttgaggagtacacgatcaaattaatcccgaccatctttaaggagtggaggccgtggcgggaacgccagattgagattaacgaatggagacagaggggtcaatcgggcgtaactatatttcgtccagactcttcccatgctaccgtgcaggataagctctcaggggaacttttcacatttcgggtgaactatcaatactcgacaacaattttctctggagtgaccagagatcataggactcggatgattaatgaggcaattgcggacatggctagctgcatatcacccacttttgctctccacatgctcctacctgatgatgtcaagacacggttttctccttatgacagggggttattcggccgggtgagcagaggcccatattctcaggatcttcttcagcaacttttcacgagtgtgaaagacttcagatcgcatccaagacgctttgatcagacggctcgtgaccgagtcgtgaaggtgattataagagcgggtcaccacgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcaagatgtgcttgcttcgttgcagctccattttgaggatggtacatcaacacggaaattcggcaatgaacttggttgggcgactagaatactgacttgtacagcgccctatggctacaggttcagctcatgggcctttcgtgaagatcccggcccctacagaacaaccgccatcagtgtactccgcttccaattcacccccgagctggatatgcccttgccagcatcttatatgctctca

SEQ ID NO: 291 - DNA, 1512 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggaggaatatatcaggaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcctgtcacccacttttgctttccacaagcttctacccgacgatattcagacgcagttctctccttacgatcggcagcagttcggacaggttttcagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacaattttggtacgatcatgtgaattcaaattctacaactacaggcattatggctggaaattctagtggggggattaggcatgagattgacgtgaaggaccggcccatacacgagttgcgcatggagttttctcacaacgtgctcgcttcattgcaacttcatttccaagatggtacagcaacgcaaaaatttggcaatgtaaatggttgggcatctagaatagccacttgcacagccccctatagctacaagcttagctcatgggcctttcgtgaagatcccggcccctataatacgacagccatcagtgtacttcgcttcgatttcacacctgaagatccctcatca

SEQ ID NO: 292 - DNA, 1536 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggaggaatatatcaggaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcctgtcacccacttttgctttccacaagctcctacccgacgatgttaagacgcggttctctccttacgatcgggggctgttcggacgggttttcagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcaagatgtgcttgcttcgttgcagctccattttcaggatggtacagcaacacagaaattcggcaatgtaaatggttgggcgtctagaatagcgacttgtacagcgccctatagctacaagctcagctcatgggcctttcgtgaagatcccggcccctacagaacaaccgccatcagtgtactccgcttccaattcacccccgagctggatatgcccttgccagcatcttatatgctctca

SEQ ID NO: 293 - DNA, 1539 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggaggaatatatcaggaacattgtccagcaggagcttatgcaattcgaaatgcggacccttcagagccgcatcgaagcgctgcaaaccactattcacagatacgatcaggctgcagctactacagaaaaggggaactttctgagcaactggatcacgcaagctgatgggttgcttagttcgatgcgaaactcttccaaccgcatccaccttctccttcacatagtcaccgtggctgcacttcatatggcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcctgtcacccacttttgctttccacatgctcctacccgacgatgttaagacgcggttctctccttacgatcgggggctgttcggacgggtttccagaggcccatattcccaggatcttttgcagcaactcttcacgtctgtcaaagacttcagatcgcacccaagacgctttgatcagacagctcgcgatagagtcgtgaaggtgatcataagagcggggcaccatgttgatgctatacagttctggtacgatcatgtaaattcaaattctacgactacggggattatggctggaaactcctcgggaggaattaggcatgagattgatgtgaaggatcgacccatacacgaattgcgcatggagttctctcacaatgtgcttgcttcgttgcagctccattttcaggatggtacagcaacacagaaattcggcaatgaacttggttgggcgactagaatactgacttgtacagcgccctatggctacaggttcagctcatgggcctttcgtgaagatcccggcccctacaacacaaccgccatcagtgtactccgcttccaattcacccccgagctggatatgcccttgccagcatcttatatgctctca

SEQ ID NO: 294 - DNA, 1536 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcaacgcggagcaatatatcacgaacattgtccagcaggagcttatgcaattcgaaatgcggacccttcagagccgcatcgaagcgctgcaaaccactattcacagatacgatcaggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaggccatggagggaacgccagatcgagattaacgaatggagacagaggggccagtccggcgttactatctttagaccagactcttctcatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcctgtcacccacttttgctctccacatgctcctacccgacgatgttaagacgcggttctctccttacgatcgggggctgtgcggacgggtttccagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcaagatgtgcttgcttcgttgcagctccattttgaggatggtacatcaacacggaaattcggcaatgaacttggttgggcgactagaatactgacttgtacagcgccctatggctacaggttcagctcatgggcctttcgtgaagatcccggcccctacaacacaaccgccatcagtgtactccgcttccaattcacccccgagctggatatgcccttgccagcatcttatatgctctca

SEQ ID NO: 295 - DNA, 1536 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgaccggcacaaccgggtcagaggcgccatactggggctgatatccgcagtgccgaaggtgggtgctgctataagcaggctcatcggcctcttttggccagcaaacaaggtgagcatttgggaggccctcagggcggaggaatatatcaggaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacagaactcggatggtgaacgaggccattgcggacatggcgagctgcctgtcacccacttttgctctccacatgctcctacccgacgatgttaagacgcggttctctccttacgatcgggggctgttcggacgggtttccagaggcccatattcccaggatcttttgcagcaactcttcacgtctgtcaaagacttcagatcgcacccaagacgctttgatcagacagctcgcgatagagtcgtgaaggtgatcataagagcggggcaccatgttgatgctatacagttctggtacgatcatgtaaatccaaatcttacgactccggggactgtggctggaaacgccgcgggaggaactaggcatgagattgatgtgaaggatcgacccatacaggaattgcgcatggagttctctcaagatgtgcttgcttcgttgcagctccattttgaggatggtacatcaacacggaaattcggcaatgaacttggttgggcgactagaatactgacttgtacagcgccctatggctacaggttcagctcatgggcctttcgtgaagatcccggcccctacagaacaaccgccatcagtgtactccgcttccaattcacccccgagctggatatgcccttgccagcatcttatatgctctca

SEQ ID NO: 296 - DNA, 1596 bp, Artificial Sequence
  coding sequence for IPD113 chimeric protein
atggactctgacctgatcgcgcagccgccggacgacaacgcggcgtctgttggtgcgccggcagctgagaaagttcaagaagatcagctggttgttaccactcctgaaatggaggacagcgacgtcgacccccaattcgaacaagaaatgataaacatatcggcgctgatagctgctggtgcagtagaggggcacgacgacgtagatcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggaggaatatatcaggaacattgtccagcaggagctttttgaattcgaaatgcggacccttcagagccgcatcgaagcgctgcaaaccactattcacagatacgatcaggctgcagctactacagaaaaggggaactttctgagcaactggatcacgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacagaactcggatgataaacgaggccattgcggacatggcgagctgcatatcacccacttttgctctccacatgctcctacccgacgatgttaagacgcggttctctccttacgatcgggggctgttcggacgggtttccagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcaagatgtgcttgcttcgttgcagctccattttgaggatggtacagcaacacagaaattcggcaatgaacttggttgggcgactagaatactgacttgtacagcgccctatggctacaggttcagctcatgggcctttcgtgaagatcccggcccctacagaacaaccgccatcagtgtactccgcttcgacttcacccccgagctggatatgcccttgccagcatcttatatgctctca

SEQ ID NO: 297 - DNA, 1536 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggaggaatatatcaggaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcctgtcacccacttttgctctccacatgctcctacccgacgatgttaagacgcggttctctccttacgatcgggggctgttcggacgggtttccagaggcccatattcccaggatcttttgcagcaactcttcacgtctgtcaaagacttcagatcgcacccaagacgctttgatcagacagctcgcgatagagtcgtgaaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcaagatgtgcttgcttcgttgcagctccattttcaggatggtacatcaacacggaaattcggcaatgaacttggttgggcgactagaatactgacttgtacagcgccctatggctacaggttcagctcatgggcctttcgtgaagatcccggcccctacagaacaaccgccatcagtgtactccgcttcgacttcacccccgagctggatatgcccttgccagcatcttatatgctctca

SEQ ID NO: 298 - DNA, 1539 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtaggtcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggagcaatatatcacgaacattgtccagcaggagcttatgcaattcgaaatgcggacccttcagagccgcatcgaagcgctgcaaaccactattcacagatacgatcaggctgcagctactacagaaaaggggaactttctgagcaactggatcacgcaagctgatgggttgcttagttcgatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcctgtcacccacttttgctttccacaagctcctacccgacgatattcagacgcagttctctccttacgatcggcagcagttcggacaggttttcagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcaagatgtgcttgcttcgttgcagctccattttgaggatggtacatcaacacggaaattcggcaatgaacttggttgggcgactagaatactgacttgtacagcgccctatggctacaggttcagctcatgggcctttcgtgaagatcccggcccctacaacacaaccgccatcagtgtactccgcttccaattcacccccgagctggatatgcccttgccagcatcttatatgctctca

SEQ ID NO: 299 - DNA, 1536 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggaggaatatatcaggaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcatatcacccacttttgctctccacatgctcctacccgacgatgttaagacgcggttctctccttacgatcgggggctgttcggacgggtttccagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcaagatgtgcttgcttcgttgcagctccattttcaggatggtacatcaacacggaaattcggcaatgaacttggttgggcgactagaatactgacttgtacagcgccctatggctacaggttcagctcatgggcctttcgtgaagatcccggcccctacagaacaaccgccatcagtgtactccgcttccaattcacccccgagctggatatgcccttgccagcatcttatatgctctca

SEQ ID NO: 300 - DNA, 1536 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatgcatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggaggaatatatcaggaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcctgtcacccacttttgctttccacatgctcctacccgacgatgttaagacgcggttctctccttacgatcgggggctgttcggacgggtttccagaggcccatattcccaggatcttttgcagcaactcttcacgtctgtcaaagacttcagatcgcacccaagacgctttgatcagacagctcgcgatagagtcgtgaaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacacgaattgcgcatggagttctctcacaatgtgcttgcttcgttgcagctccattttcaggatggtacatcaacacggaaattcggcaatgtaaatggttgggcgactagaatactgacttgtacagcgccctatggctacaggttcagctcatgggcctttcgtgaagatcccggcccctacagaacaaccgccatcagtgtactccgcttccaattcacccccgagctggatatgcccttgccagcatcttatatgctctca

SEQ ID NO: 301 - DNA, 1536 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtgagcatttgggaggccctcagggcggaggaatatatcaggaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaggccatggagggaacgccagatcgagattaacgaatggagacagaggggccagtccggcgttactatctttagaccagactcttctcatgctacagtgcaggacaagctctccggggaattattcacatttcgggtaaactatcaatactcgacaacaattttctcaggagttaccagagaccacaaaactcggatggtgaacgaggccattgcggacatggcgagctgcctgtcacccacttttgctttccacaagctcctacccgacgatgttaagacgcggttctctccttacgatcgggggctgttcggacgggtttccagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcaagatgtgcttgcttcgttgcagctccattttgaggatggtacatcaacacggaaattcggcaatgaacttggttgggcgactagaatactgacttgtacagcgccctatggctacaagctcagctcatgggcctttcgtgaagatcccggcccctacagaacaaccgccatcagtgtactccgcttcgacttcacccccgagctggatatgcccttgccagcatcttatatgctctca

SEQ ID NO: 302 - DNA, 1545 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcagaaccggctcagacaggccatactggggctgacactcgcaataccgaacccgatagtgggtcttgctataagcgggttcatccgcctcctttggccagcaaacaaggtgagcatttgggaggccctcaacgcggagcaatatatcacgaacattgtccagcaggagcttatgcaattcgaaatgcggacccttcagagccgcatcgaagcgctgcaaaccactattcacagatacgatcaggctgcagctactacagaaaaggggaactttctgagcaactggatcacgcaagctgatgggttgcttagttcgatgcgaaactcttccaaccgcatccaccttctccttcacatagtcaccgtggctgcacttcatatggcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcctgtcacccacttttgctttccacaagctcctacccgacgatattcagacgcagttctctccttacgatcggcagcagttcggacgggttttcagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttctggtacgatcatgtaaattcaaattctacgactacggggattatggctggaaacgccgcgggaggaactaggcatcaggttgatgtgagggatcgacccatacaggaattgcgcatggagttctctcaagatgtgcttgcttcgttgcagctccattttgaggatggtacatcaacacggaaattcggcaatgaacttggttgggcgactagaatactgacttgtacagcgccctatggctacaggttcagctcatgggcctttcgtgaagatcccggcccctacaacacaaccgccatcagtgtactccgcttcgacttcacccccgagctggatatgcccttgccagcatcttatatgctctca

SEQ ID NO: 303 - DNA, 1545 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcagaaccggctcagacaggccatactggggctgacactcgcaataccgaacccgatagtgggtcttgctataagcgggttcatccgcctcctttggccagcaaacaaggtggacatttgggaggccctcaacgcggagcaatatatcacgaacattgtccagcaggagcttatgcaattcgaaatgcggacccttcagagccgcatcgaagcgctgcaaaccactattcacagatacgatcaggctgcagctactacagaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcctgtcacccacttttgctttccacaagctcctacccgacgatattcagacgcagttctctccttacgatcggcagcagttcggacaggttttcagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcaagatgtgcttgcttcgttgcagctccattttgaggatggtacatcaacacggaaattcggcaatgaacttggttgggcgactagaatactgacttgtacagcgccctatggctacaggttcagctcatgggcctttcgtgaagatcccggcccctacaacacaaccgccatcagtgtactccgcttcgacttcacccccgagctggatatgcccttgccagcatcttatatgctctca

SEQ ID NO: 304 - DNA, 1536 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgccaaatacatgcaagtggaggctcatgactggcacaaccgggtcagaggcgccatactggggctgatatccgcagtgccgaaggtgggtgctgctataagcaggctcatcggcctcttttggccagcaaacaaggtgagcatttgggaggccctcagggcggaggaatatatcacgaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcctgtcacccacttttgctttccacaagctcctacccgacgatgttaagacgcggttctctccttacgatcgggggctgttcggacgggtttccagaggcccatattcccaggatcttttgcagcaactcttcacgtctgtcaaagacttcagatcgcacccaagacgctttgatcagacagctcgcgatagagtcgtgaaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcacaatgtgcttgcttcgttgcagctccattttgaggatggtacatcaacacggaaattcggcaatgaacttggttgggcgactagaatactgacttgtacagcgccctatggctacaggttcagctcatgggcctttcgtgaagatcccggcccctacagaacaaccgccatcagtgtactccgcttccaattcacccccgagctggatatgcccttgccagcatcttatatgctctca

SEQ ID NO: 305 - DNA, 1545 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcacaaccgggtcagaggcgccatactggggctgacactcgcaataccgaacccgatagtgggtcttgctataagcgggttcatccgcctcctttggccagcaaacaaggtgagcatttgggaggccctcaacgcggagcaatatatcacgaacattgtccagcaggagcttatgcaattcgaaatgcggacccttcagagccgcatcgaagcgctgcaaaccactattcacagatacgatcaggctgcagctactacagaaaaggggaactttctgagcaactggatcacgcaagctgatgggttgcttagttcgatgcgaaactcttccaaccgcatccaccttctccttcacatagtcaccgtggctgcacttcatatggcagccctgcatgagcgactgacatttggcgaggaactgtatggcttaaacgatacggcgagttggcagcgagctcttgtggaaatgttcgaggagtacacaatcaaattaatcccgactattttcaaagagtggaggccatggagggaacgccagatcgagattaacgaatggagacagaggggccagtccggcgttactatctttagaccagactcttctcatgctacagtgcaggacaagctctccggggaattattcacatttcgggtaaactatcaatactcgacaacaattttctcaggagttaccagagaccacaaaactcggatgataaacgaggccattgcggacatggcgagctgcatatcacccacttttgctttccacaagctcctacccgacgatattcagacgcagttctctccttacgatcggcagcagttcggacaggttttcggaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttctggtacgatcatgtaaattcaaattctacgactacggggattatggctggaaactcctcgggaggaattaggcatgagattgatgtgaaggatcgacccatacacgaattgcgcatggagttctctcacaatgtgcttgcttcgttgcagctccattttcaggatggtacagcaacacagaaattcggcaatgtaaatggttgggcgtctagaatagcgacttgtacagcgccctatggctacaggttcagctcatgggcctttcgtgaagatcccggcccctacagaacaaccgccatcagtgtactccgcttccaattcacccccgagctggatatgcccttgccagcatcttatatgctctca

SEQ ID NO: 306 - DNA, 1536 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggaggaatatatcaggaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcctgtcacccacttttgctttccacaagctcctacccgacgatgttaagacgcggttctctccttacgatcgggggctgttcggacgggtttccagaggcccatattcccaggatcttttgcagcaactcttcacgtctgtcaaagacttcagatcgcacccaagacgctttgatcagacagctcgcgatagagtcgtgaaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacacgaattgcgcatggagttctctcacaatgtgcttgcttcgttgcagctccattttcaggatggtacagcaacacagaaattcggcaatgtaaatggttgggcgactagaatactgacttgtacagcgccctatggctacaggttcagctcatgggcctttcgtgaagatcccggcccctacagaacaaccgccatcagtgtactccgcttccaattcacccccgagctggatatgcccttgccagcatcttatatgctctca

SEQ ID NO: 307 - DNA, 1536 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcacaaccgggtcagaggcgccatactggggctgatatccgcagtgccgaaggtgggtgctgctataagcaggctcatcggcctcctttggccagcaaacaaggtggacatttgggaggccctcagggcggaggaatatatcaggaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagctctccggggcattattctcatttcaggcaacaaatcgaaactcgacaacacttttcttagaagtttgcgaagaccacaaaactcggatggtgaacgaggccattgcggacatggcgagctgcatatcacccacttttgctctccacaagctcctacccgacgatgttaagacgcggttctctccttacgatcgggggctgttcggacgggtttccagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcaagatgtgcttgcttcgttgcagctccattttgaggatggtacatcaacacggaaattcggcaatgaacttggttgggcgactagaatactgacttgtacagcgccctatggctacaagctcagctcatgggcctttcgtgaagatcccggcccctacagaacaaccgccatcagtgtactccgcttcgacttcacccccgagctggatatgcccttgccagcatcttatatgctctca

SEQ ID NO: 308 - DNA, 1536 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggaggaatatatcaggaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaacgaggccattgcggacatggcgagctgcctgtcacccacttttgctttccacatgctcctacccgacgatattcagacgcagttctctccttacgatcgggggctgttcggacgggtttccagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcacaatgtgcttgcttcgttgcagctccattttgaggatggtacatcaacacggaaattcggcaatgaacttggttgggcgtctagaatagcgacttgtacagcgccctatagctacaagctcagctcatgggcctttcgtgaagatcccggcccctacagaacaaccgccatcagtgtactccgcttccaattcacccccgagctggatatgcccttgccagcatcttatatgctctca

SEQ ID NO: 309 - DNA, 1536 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggaggaatatatcaggaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcacaaacaattcgacgaattggacgcgagatcttgtggacaagttcgagacgtacacatccgatttaatcccgaatgttttcaaaaggtggaaggaatggaggccaacccagatcgagattagcgcatgggtacgcaggggctcgtgcggcaatcttacctgtagaccagacgtttcttatgctacagtggaggacaagatctccggggcattattctcatttcaggcaacaaatcgaaactcgacaacacttttcttagaagtttgcgaagaccacaaaactcggatggtgaatgaggccattgcggacatggcgagctgcatatcacccacttttgctctccacatgctcctacccgacgatattcagacgcagttctctccttacgatcgggggctgttcggacgggtttccagaggcccatattcccaggatctttcgcacggactctggacggctttcaaaaacttcagatcgcgcacaacacgctctgatcagacacttcgcgatagaatcttggaggtgatcataagagcggggcaccatgttgatgctatacagttcgtgtacgatcattcaaatccaaatcttacgactccggggactgtggctggaaacgccgcgggaggaactaggcatcaggttgatgtgagggatcgacccatacaggaattgcgcatggagttctctcaagatgtgcttgcttcgttgcagctccattttgaggatggtacagcaacacagaaattcggcaatgtaaatggttgggcgactagaatactgacttgtacagcgccctatggctacaggttcagctcatgggcctttcgtgaagatcccggcccctacagaacaaccgccatcagtgtactccgcttccaattcacccccgagctggatatgcccttgccagcatcttatatgctctca

SEQ ID NO: 310 - DNA, 1536 bp, Artificial Sequence
  coding sequence for IPD113 chimeric protein
atggcagctgagggcgttgaaactgtttctgagcttgctcccgctactgataaggtgcagaacgcagacatggccgaagaggacccaatttttacgcaattagcgcagaagatggctgctgctgcagaaaaggaggaggtccccgtagatcttcttgcccaatacatgcaagtggaggctcatgactggcacaaccgggtcagaggcgccatactggggctgatatccgcagtgccgaaggtgggtgctgctataagcaggctcatcggcctcttttggccagcaaacaaggtggacatttgggaggccctcagggcggaggaatatatcaggaacattgtccagcaggagctttttgaattcgaaatgcggctccttgagaacgacatccaagcgctggaaaccactgttgggagatacgatacggctgcacttactgaaaaggggaactttctgagcatctggatctcgcaagctgatgcgttgtatattcggatgcgaaactctaccaacaacatccaccttctccttcacatggtcaccgtgtctacacttcatctcgcagccctgcatgagcgactgacatttggcgaggaactgtatggcttaaacgatacggcgagttggcagcgagctcttgtggaaatgttcgaggagtacacaatcaaattaatcccgactattttcaaagagtggaggccatggagggaacgccagatcgagattaacgaatggagacagaggggccagtccggcgttactatctttagaccagactcttctcatgctacagtgcaggacaagctctccggggaattattcacatttcgggtaaactatcaatactcgacaacaattttctcaggagttaccagagaccacagaactcggatgataaacgaggccattgcggacatggcgagctgcatatcacccacttttgctctccacatgctcctacccgacgatattcagacgcagttctctccttacgatcggcagcagttcggacgggtttccagaggcccatattcccaggatcttttgcagcaactcttcacgtctgtcaaagacttcagatcgcacccaagacgctttgatcagacagctcgcgatagagtcgtgaaggtgatcataagagcggggcaccatgttgatgctatacagttctggtacgatcatgtaaattcaaattctacgactacggggattatggctggaaactcctcgggaggaattaggcatgagattgatgtgagggatcgacccatacaggaattgcgcatggagttctctcacaatgtgcttgcttcgttgcagctccattttgaggatggtacatcaacacggaaattcggcaatgaacttggttgggcgactagaatactgacttgtacagcgccctatggctacaggttcagctcatgggcctttcgtgaagatcccggcccctacaacacaaccgccatcagtgtactccgcttcgacttcacccccgagctggatatgcccttgccagcatcttatatgctctca

SEQ ID NO: 311 - protein, 523 aa, Artificial Sequence
  IPD113 chimeric protein
MDSDLIAQPPDDNAASVGAPAAEKVQEDQLVVTTPEMEDSDVDPQFEQEMINISALIAAGAVEGHDDVDLFAKYMQVEAHDWHNRIRGAILGLISAVPKVGAAISRLIGLFWPSNKVDIWEALNAEEYIRNIVQQELFEFEMQLLQNDIQALETTVGRYDTAALTEKGNFLSIWISQADALYIRMRNSTNNIHLLLHMVTVSTLHLAALHERLTFGEELYGTNNAANWTQDLVDKFERYTIKLIPTIFKEWRPWRERQIEINEWRQRGQSGVTIFRPDSSHATVQDKLSGELFTFRVNYQYSTTIFSGVTRDHRTRMINEAIADMASCISPTFALHMLLPDDVKTRFSPYDRGLFGRVSRGPYSQDLLQQLFTSVKDFRSHPRRFDQTARDRVVKVIIRAGHHVDAIQFWYDHVNSNSTTTGIMAGNSSGGIRHEIDVKDRPIHELRMEFSHNVLASLQLHFQDGTATQKFGNVNGWASRIATCTAPYSYKLSSWAFREDPGPYNTTAISVLRFDFTPEDPSS

SEQ ID NO: 312 - protein, 524 aa, Artificial Sequence
  IPD113 chimeric protein
MDSDLIAQPHDDNAASVGAPAAEKVEEEESVVTMPETDQDSDVDPQFEQEMNNISALIAAGAVEGHDDVDLFAKYMQVEAHDWHNRIRGAILGLISAVPKVGAAISRLIGLFWPSNKVDIWEALNAEEYIRNIVQQELFEFEMQLLQNDIQALETTVGRYDTAALTEKGNFLSIWISQADALYIRMRNSTNNIHLLLHMVTVSTLHLAALHERLTFGEELYGTNNAANWTQDLVDKFERYTIKLIPTIFKEWRPWRETQIEINEWRQRGQSGVSIFRPDSSHATVQDKLSGELFTFRVNYQYSTTIFSGVTRDHRTRMINEAIADMASCISPTFALHTLLPDDVKTKYSPYDKAIFGRVSRGPYSQDLRQQLFTIVKDFRSHPRRFDQTARDRVLEVIIRAQHHVDAIQFLYDHANPNLTTNGLMAGNSSGGIRYQINVRDRPIEELRMEFSRDVLASLQLHFQDGTATQKFGNVNSWATTIATCTAPFGYKLSSWAFREDPGPNGTLAISVLRFDFTPEDPST

SEQ ID NO: 313 - protein, 526 aa, Artificial Sequence
  IPD113 chimeric protein
MAGYNHVQDQLVMAADQDVNTVSELAPATDKVQNEDMVEEDPIFAQLAEKMAAAAEKGEAPVDLLAQYMQVEAHDWHNRIRGAILGLISAVPKVGAAISRLIGLFWPSNKVDIWEALNAEEYIRNIVQQELFEFEMQLLQNDIQALETTVGRYDTAALTEKGNFLSIWISQADALYIRMRNSTNNIHLLLHMVTVSTLHLAALHERLTFGEELYGTNNAANWTQDLVDKFERYTADLIPSVFKRWKEWRPTQIEIRAWINRGSCGNLTCRPNVSHATVEDKTSGARFSFQSSGSSSTTMFSEICEDHKIRMVNEAIADMASCLSPTFAFHKLLPDDIQAQFSPYDRQEFGQVFRGPYSQDLSHGAWTNFKNFRSRTTRSDQTLRDRILEVIIRAGSHVDALQFIYDHVNPNSMTPGIMAGNAAGGVRHQVDVRDRPIQEVRMEFARDVLASLQLHFEDGTSTQKFGNELFGTWATRILTCTAPYGYRFSSWAFREDPGPYRTTAISVLRFQFTPELDMPLPSEYLI

SEQ ID NO: 314 - protein, 498 aa, Artificial Sequence
  IPD113 chimeric protein
MAAPGMKDSEVIADVVTTPVSAVPDEEVQELDKLGLQEVADNIDVLAKYMQTEAHDWHNRIRGAILGLISAVPKVGAAISRLIGLFWPSNKVDIWEALNAEEYIRNIVQQELFEFEMQLLQNDIQALETTVGRYDTAALTEKGNFLSIWISQADALYIRMRNSTNNIHLLLHMVTVSTLHLAALHERLTFGEELYGTNNAANWTQDLVDKFERYTSNIVPNLFKEWRQWRESQIEIKAWVVRGVWGNITSTPDVSHATVEDKISGEKFAFRVARRNSTTIFSAICEDHKTRMLNEAIADMAACLSPTFAFHKLLPNDTQMQLSPYDKELFGQVFRGPYSHDLLQPLFTALKSFRSRPTRFDQTARDKILEVTIRAGHHVDAIQFWYDHVNSNAMTAGIVAGNSAGGSRHQVDVRNRRIQDLRLEFSRDVLASLQLHFEDGTSTRKFGNEAGWATNIVTCTTPSGYRLSSWAFREDPGPYNTTAISVLRFQFTPEDPSS

SEQ ID NO: 315 - protein, 533 aa, Artificial Sequence
  IPD113 chimeric protein
MAAPGVKAEDVTASPAEPEENVHEVKLATTTDMEEGGGPLHGEKAGGVSSSHQHHEAGSLDDAIVEEFARNSQMEAHDWHNRIRGAILGLISAVPKVGAAISRLIGLFWPSNKVDIWEALNAEEYIRNIVQQELFEFEMQLLQNDIQALETTVGRYDTAALTEKGNFLSIWISQADALYIRMRNSTNNIHLLLHMVTVSTLHLAALHERLTFGEELYGTNNAANWTQDLVDKFERYTSDLIPSLFRKWKQWREGLIEIRSWVVPGRWGNLVQLPDVSHATVEDKLTGAIVRFSVARRNSTTIFLDVCQDHKSRMANEAVADMASCMSSTFAFRSLLPDRIQGQYPAYDRELFGQVFRGPYSQDHCRLVVTEFRTFRTRPTHFDQTAIDRVSELIVMTAIHFGTMQFVYFDNNSRIPGLVAGNASGGGRWQRHVIDVLDKPIRDLRLEFNNEALASLQLSFEDGSSTPRLGNFSGSAEEKVTCTVPRGYRLSSWAFRADPAISVLRFQFTPEELRPSSRVRPQYTTPALHPIIN

SEQ ID NO: 316 - protein, 512 aa, Artificial Sequence
  IPD113 chimeric protein
MAAKDVNTVSELAPAADQKEQNDATGMAEEDPIFAQLAQKMAAAAEKEEAPVDLLAQYMQVEAHDWQNRLRQAILGLTLAIPNPIVGLAISGFIRLLWPANKVSIWEALNAEQYITNIVQQELMQFEMRTLQSRIEALQTTIHRYDQAAATTEKGNFLSNWITQADGLLSSMRNSSNRIHLLLHIVTVAALHMAALHERLTFGEELYGLNDTASWQRALVEMFEEYTTDLIPNVFRRWKEWRPTQIEITTWVRRGSCGNLTCRPDVSYATVEDKISGALFSFQATNRNSTTIFSEVCEDHKTRMVNEAIADMASCLSPTFAFHKLLPDDIQTQFSPYDRQQFGQVFRGPYSQDLSHGLWTVFKSFRSRTTRSDQTLRDRILEVIIRAGHHVDAIQFVYDHVNPNSTTPGIVAGNAAGGTRHQIDVRDRPIKEVRMEFSQDVLASLQLHFEDGTSTRKFGNELGWATRILTCTVPYGYRFSSWAFREDPGPYRTTAISVLRFQFTPELDFPLS

SEQ ID NO: 317 - protein, 512 aa, Artificial Sequence
  IPD113 chimeric protein
MAAKDVNTVSELAPAADQKEQNDATGMAEEDPIFAQLAQKMAAAAEKEEAPVDLLAQYMQVEAHDWHNRLRQAILGLTLAIPNPIVGLAISGFIRLIWPANKVSIWEALNAEQYIRNIVQQELMQFEMRTLQSQIETLQTTIHRYDQAAAIPEKGNFLSNWISQADGLFSSMRNSSNRIHLLLHIVTVATLHMAALHERLSFGKELYGVDDTASWKRALEQMFEEYTTDLIPNVFRRWKEWRPTQIEITTWVRRGSCGNLTCRPDVSYATVEDKISGALFSFQATNRNSTTIFSEVCEDHKTRMVNEAIADMASCLSPTFAFHKLLPDDIQTQFSPYDRQQFGQVFRGPYSQDLSHGLWTVFKSFRSRTTRSDQTLRDRILEVIIRAGHHVDAIQFVYDHVNPNSTTPGIVAGNAAGGTRHQIDVRDRPIKEVRMEFSQDVLASLQLHFEDGTSTRKFGNELGWATRILTCTVPYGYRFSSWAFREDPGPYRTTAISVLRFQFTPELDFPLS

SEQ ID NO: 318 - protein, 509 aa, Artificial Sequence
  IPD113 chimeric protein
MAAKDVNTVSELAPAADQKEQNDATGMAEEDPIFAQLAQKMAAAAEKEEAPVDLLAQYMQVEAHDWHNRIRGAILGLISLVPKVGAAVSRLIGLFWPANKVDIWEALKAEEYIRNIVQQELFEFEMRLLQDDIEALEMTVARYDRAALTEKGNFLSIWISQADALYIRMRNSTNNIHLLLHMVTVSTLHMAALHERLTFGEELYGTNNSANWTQDLVDKFERYTTDLIPNVFRRWKEWRPTQIEITTWVRRGSCGNLTCRPDVSYATVEDKISGALFSFQATNRNSTTIFSEVCEDHKTRMVNEAIADMASCLSPTFAFHKLLPDDIQTQFSPYDRQQFGQVFRGPYSQDLSHGLWTVFKSFRSRTTRSDQTLRDRILEVIIRAGHHVDAIQFVYDHVNPNSTTPGIVAGNAAGGTRHQIDVRDRPIKEVRMEFSQDVLASLQLHFEDGTSTRKFGNELGWATRILTCTVPYGYRFSSWAFREDPGPYRTTAISVLRFQFTPELDFPLS

SEQ ID NO: 319 - protein, 509 aa, Artificial Sequence
  IPD113 chimeric protein
MAAKDVNTVSELAPAADQKEQNDATGMAEEDPIFAQLAQKMAAAAEKEEAPVDLLAQYMQVEAHDWHNRTRGAVLGIISAIPKVGAAISMLIGLFWPANKVDIWVALNAEEYVRNIVRQEIFEFEMQQHKSEIEALEAAISRYDTVALTEKGNFLSIWIWQADRLCIQLRNSANRIHLLLHIVTVAVLHIAAMHERFTFGEEIYGTNNTAAWRKDFVDVFEMYTTDLIPNVFRRWKEWRPTQIEITTWVRRGSCGNLTCRPDVSYATVEDKISGALFSFQATNRNSTTIFSEVCEDHKTRMVNEAIADMASCLSPTFAFHKLLPDDIQTQFSPYDRQQFGQVFRGPYSQDLSHGLWTVFKSFRSRTTRSDQTLRDRILEVIIRAGHHVDAIQFVYDHVNPNSTTPGIVAGNAAGGTRHQIDVRDRPIKEVRMEFSQDVLASLQLHFEDGTSTRKFGNELGWATRILTCTVPYGYRFSSWAFREDPGPYRTTAISVLRFQFTPELDFPLS

SEQ ID NO: 320 - protein, 509 aa, Artificial Sequence
  IPD113 chimeric protein
MAAKDVNTVSELAPAADQKEQNDATGMAEEDPIFAQLAQKMAAAAEKEEAPVDLLAQYMQVEAHDWHNRTRDVVLALISIIPTVGAIASVVLGIFWPANKVDIWVALSLEEYVRNIVKQEIFEFEMRQHQSSIEALESTIRRYNTAALPEKGNFLSIWISQADALCIRLRNSTNDIHLLLHIVTVSVLHMAAMHERLTFGEELYGTDNTANWTRDLVEVFQMYTTDLIPNVFRRWKEWRPTQIEITTWVRRGSCGNLTCRPDVSYATVEDKISGALFSFQATNRNSTTIFSEVCEDHKTRMVNEAIADMASCLSPTFAFHKLLPDDIQTQFSPYDRQQFGQVFRGPYSQDLSHGLWTVFKSFRSRTTRSDQTLRDRILEVIIRAGHHVDAIQFVYDHVNPNSTTPGIVAGNAAGGTRHQIDVRDRPIKEVRMEFSQDVLASLQLHFEDGTSTRKFGNELGWATRILTCTVPYGYRFSSWAFREDPGPYRTTAISVLRFQFTPELDFPLS

SEQ ID NO: 321 - DNA, 1569 bp, Artificial Sequence
  coding sequence for IPD113 chimeric protein
atggattccgatctgattgctcagcctcctgacgataacgctgcttctgtgggtgccccggctgcagagaaggttcaggaggatcagttggtagtgacaacgccagaaatggaggactcagacgttgatccgcaattcgaacaagaaatgatcaatatttctgcgcttatcgctgctggtgcagtggaggggcacgacgacgtagatcttttcgccaaatacatgcaggtcgaggctcatgactggcataaccggatcagaggcgccatattggggctgatatccgcagtgccgaaggtgggtgctgctataagcaggctcatcggcctcttttggccatcaaacaaggtggacatttgggaggccctcaacgcggaggagtatatcaggaacattgtccagcaggagcttttcgaattcgaaatgcagcttcttcagaacgacatccaagcgctggaaaccacggttgggagatacgatacggctgcacttactgaaaagggcaactttctaagcatctggatctcgcaagctgatgcgttgtatattcggatgcgaaactctaccaacaacatccaccttctccttcacatggtcaccgtgtctacacttcatctcgcagccctacatgagcgactcacatttggcgaggaactgtatggcacaaacaatgcagcgaattggacacaagatcttgtggataagttcgagaggtacacgatcaaattaatcccgaccatctttaaggagtggaggccgtggcgggaacgccagattgagattaacgaatggagacagaggggtcaatcgggcgtaactatatttcgtccagactcttcccatgctaccgtgcaggataagctctcaggggaacttttcacatttcgggtgaactatcaatactcgacaacaattttctctggagtgaccagagatcataggactcggatgattaatgaggcaattgcggacatggctagctgcatatcacccacttttgctctccacatgctcctacctgatgatgtcaagacacggttttctccttatgacagggggttattcggccgggtgagcagaggcccatattctcaggatcttcttcagcaacttttcacgagtgtgaaagacttcagatcgcatccaagacgctttgatcagacggctcgtgaccgagtcgtgaaggtgattataagagcgggtcaccacgttgatgctatacaattttggtacgatcatgtgaattcaaattctacaactacaggcattatggctggaaattctagtggggggattaggcatgagattgacgtgaaggaccggcccatacacgagttgcgcatggagttttctcacaacgtgctcgcttcattgcaacttcatttccaagatggtacagcaacgcaaaaatttggcaatgtaaatggttgggcatctagaatagccacttgcacagccccctatagctacaagcttagctcatgggcctttcgtgaagatcccggcccctataatacgacagccatcagtgtacttcgcttcgatttcacacctgaagatccctcatca

SEQ ID NO: 322 - DNA, 1572 bp, Artificial Sequence
  coding sequence for IPD113 chimeric protein
atggattcggatttgattgctcagcctcatgacgataacgccgcttctgtgggtgccccggctgcagagaaggttgaggaggaagagtcggtagtgacaatgccagaaacggatcaggactcagacgttgatccgcaattcgaacaagaaatgaacaatatttctgcgcttatcgctgctggtgcagtggaggggcacgacgacgtagatcttttcgccaaatacatgcaggtcgaggctcacgactggcataaccggatcagaggcgccatattggggctgatatccgcagtgccgaaggtgggtgctgctataagcaggctcatcggcctcttttggccatcaaacaaggtggacatttgggaggccctcaacgcggaggagtatatcaggaacattgtccagcaggagcttttcgaattcgaaatgcagcttcttcagaacgacatccaagcgctggaaaccacggttgggagatacgatacggctgcacttactgaaaagggcaactttctaagcatctggatctcgcaagctgatgcgttgtatattcggatgcgaaactctaccaacaacatccaccttctccttcacatggtcaccgtgtctacacttcatctcgcagccctacatgagcgactcacatttggcgaggaactgtatggcacaaacaatgcagcgaattggacacaagatcttgtggataagttcgagaggtacacgatcaaattaatcccgacaatcttcaaggagtggaggccgtggcgggaaacccagattgagattaacgaatggagacagaggggtcaatcgggcgtaagtatatttcgtccagactcttcgcatgctaccgtgcaggataagctttcaggggaacttttcacatttcgggtgaattatcaatactcgacaacaattttttctggagtgaccagagatcataggactcggatgataaatgaggcaattgcggacatggctagctgcatatcacccacttttgctctccacacgctcctacctgatgatgtcaagacaaagtattctccttacgacaaggcgatattcggtcgggtgagcagaggcccatattctcaagatcttcgtcaacaacttttcacgattgtcaaagatttcagatcgcatccaagacgctttgatcagaccgctcgtgatagagtcttggaggtgattataagagcgcagcaccacgttgatgctatacagtttttgtacgatcatgcaaatccaaatcttacaactaatggcctcatggctggaaattctagcggggggattaggtatcagattaacgtgagggaccggcccatagaagagttgcgcatggagttttctcgcgacgtgctcgcttcattgcaacttcatttccaagatggtacagcaacgcagaaatttggcaatgtaaatagttgggcaactacaatagccacttgcacggccccctttggctacaagcttagctcatgggcctttcgtgaagatcctggccccaatgggacgttagccattagcgtacttcggttcgatttcacacctgaagatccctcaaca

SEQ ID NO: 323 - DNA, 1578 bp, Artificial Sequence
  coding sequence for IPD113 chimeric protein
atggcaggatataatcacgtgcaggatcaattagtaatggcagctgatcaggacgttaatactgtttctgagcttgctcccgctactgataaggtgcagaacgaagacatggtcgaagaggacccaatttttgcgcaattagcggagaagatggctgctgctgcagagaaaggggaggcccctgtagatcttcttgctcaatacatgcaagtggaggctcatgactggcataaccggatcagaggcgccatattggggctgatatccgcagtgccgaaggtgggtgctgctataagcaggctcatcggcctcttttggccatcaaacaaggtggacatttgggaggccctcaacgcggaggagtatatcaggaacattgtccagcaggagcttttcgaattcgaaatgcagcttcttcagaacgacatccaagcgctggaaaccacggttgggagatacgatacggctgcacttactgaaaagggcaactttctaagcatctggatctcgcaagctgatgcgttgtatattcggatgcgaaactctaccaacaacatccaccttctccttcacatggtcaccgtgtctacacttcatctcgcagccctacatgagcgactcacatttggcgaggaactgtatggcacaaacaatgcagcgaattggacacaagatcttgtggataagttcgagaggtacacagccgatttaatcccgagtgttttcaaaaggtggaaggaatggaggccaacccagatcgagattagagcatggataaataggggctcatgcggcaatcttacttgtagaccaaacgtttctcatgctacagtggaggacaagacctccggggcaagattctcatttcagtcaagcggtagttcctcgacaacaatgttctcagaaatttgcgaagaccacaaaattcggatggtgaacgaggccatcgcggacatggcgagctgcctgtcacccacttttgctttccacaagctcctacccgacgatattcaggcgcagttctctccttacgatcggcaggagttcggacaggttttcagaggcccgtattcccaggatctttcgcacggagcttggacaaatttcaaaaacttcagatcgcgcacaacacgctctgatcagacacttcgcgatagaatcttggaggtgatcataagagcgggatctcatgttgatgctttacagttcatctacgatcatgtgaatccaaattctatgactccggggattatggctggaaatgccgcgggaggagttaggcatcaggttgatgtgagggatcggcccatacaggaagtgcgcatggagttcgctcgggatgtgcttgcttcgctgcagctccatttcgaggatggtacatcaacacagaaattcggcaatgaactttttggtacttgggcgactagaatactaacttgtacagcgccctatggctacagattcagctcatgggcctttcgtgaagatcccggcccctacagaacaaccgccatcagtgtactccgcttccaattcacccccgagctggatatgcccctcccctcagagtatctcata

SEQ ID NO: 324 - DNA, 1494 bp, Artificial Sequence
  coding sequence for IPD113 chimeric protein
atggcagcgccgggaatgaaggactcggaagtgattgctgacgtcgttactactcctgtgtctgctgtgcctgatgaggaggtgcaggaactggataaattggggctgcaggaggtagccgataacatagatgtacttgcgaaatacatgcaaacggaggctcatgactggcataaccggatcagaggcgccatattggggctgatatccgcagtgccgaaggtgggtgctgctataagcaggctcatcggcctcttttggccatcaaacaaggtggacatttgggaggccctcaacgcggaggagtatatcaggaacattgtccagcaggagcttttcgaattcgaaatgcagcttcttcagaacgacatccaagcgctggaaaccacggttgggagatacgatacggctgcacttactgaaaagggcaactttctaagcatctggatctcgcaagctgatgcgttgtatattcggatgcgaaactctaccaacaacatccaccttctccttcacatggtcaccgtgtctacacttcatctcgcagccctacatgagcgactcacatttggcgaggaactgtatggcacaaacaatgcagcgaattggacacaagatcttgtggataagttcgagaggtacacatccaatatagtcccaaatctcttcaaggagtggaggcagtggagggaaagccagattgagattaaagcatgggtagtaaggggtgtatggggtaatattacttccaccccagacgtttctcatgcaacagtggaggataagatctcaggggagaaattcgcgtttcgggtagcgaggcgaaattcaacaacgattttctcagctatttgcgaagatcacaaaactcggatgttgaatgaggccattgcagacatggccgcctgcttgtcacccacttttgcttttcacaagctcctaccgaacgatacccaaatgcaattatctccttatgataaggagctgttcgggcaagtttttcgaggcccatattcacatgatcttttgcagccactcttcacagctctcaaatccttcagatcacgtccaactcgctttgatcaaacggctcgcgacaaaatcttggaggtgactatccgagcggggcaccatgttgatgctatacaattttggtacgatcatgtaaattcaaatgctatgactgcgggaattgtggccggaaactctgcaggggggagtaggcatcaagttgatgtgaggaatcgacgcatacaagatttgcgcttggagttttctagagatgtgcttgcttcgttgcaacttcatttcgaagatggtacatcaacacgaaaatttggcaatgaagcgggctgggctactaatatagtaacttgtacgaccccctctggctacaggctgagctcatgggcctttcgtgaggatcccggcccctacaacacaaccgccatcagtgtactccgcttccaattcaccccagaggatccctcgtca

SEQ ID NO: 325 - DNA, 1599 bp, Artificial Sequence
  coding sequence for IPD113 chimeric protein
atggcagcgcccggcgtcaaggctgaggacgttacagcgtcaccagctgagcctgaggagaatgtgcatgaggtgaagctagcaacgacaacggacatggaggaggggggtggtccccttcatggggagaaagcgggtggagtgtcatccagccatcaacatcacgaggcggggagcctggatgatgctattgtagaggagtttgcccgaaattcgcaaatggaagcccatgactggcataaccggatcagaggcgccatattggggctgatatccgcagtgccgaaggtgggtgctgctataagcaggctcatcggcctcttttggccatcaaacaaggtggacatttgggaggccctcaacgcggaggagtatatcaggaacattgtccagcaggagcttttcgaattcgaaatgcagcttcttcagaacgacatccaagcgctggaaaccacggttgggagatacgatacggctgcacttactgaaaagggcaactttctaagcatctggatctcgcaagctgatgcgttgtatattcggatgcgaaactctaccaacaacatccaccttctccttcacatggtcaccgtgtctacacttcatctcgcagccctacatgagcgactcacatttggcgaggaactgtatggcacaaacaatgcagcgaattggacacaagatcttgtggataagttcgagaggtacacatccgatttaatcccaagcctgttcaggaagtggaagcagtggagggagggactgattgagattagatcgtgggtcgtaccgggtcgatggggcaatctggttcagttaccagatgtttctcatgctacagtggaggataagctcacaggggcgattgtcaggttttcagtagcacgacgaaattcaacaacgattttcttagatgtgtgtcaagaccacaaatccaggatggcgaatgaggccgttgcagacatggccagctgcatgtcatctacttttgcttttcgcagcctcctcccggaccgcattcagggccaataccccgcttatgatagagagctgttcggccaagttttcagaggcccatattcacaggatcactgtaggctggtcgtcacggaattcagaacgttcagaacacggccaacccactttgatcaaacagctatagacagagtctcggagctgattgtaatgacggcaatccattttggcaccatgcaattcgtctacttcgacaataactccaggattccagggcttgtggccggaaacgctagtggcggagggcgctggcaacgtcacgttatcgatgtgttggataagcccatacgcgatctgcgactggagttcaataatgaagcccttgcctcgctgcagcttagtttcgaagatggttcatcaacgccaaggctcggcaacttttcgggttcggcggaggaaaaagtgacctgcacagtccctcgcggctacaggctcagctcatgggccttccgcgcagatcctgccattagtgtgctccgcttccaattcacccccgaagagctccgacccagctcacgggtccggccccagtacaccacccctgcactccaccccataataaat

SEQ ID NO: 326 - DNA, 1536 bp, Artificial Sequence
  coding sequence for IPD113 chimeric protein
atggcagctaaggacgttaatactgtttctgagctagctcccgctgctgatcagaaggagcagaacgacgccacaggcatggccgaagaggacccaatttttgcgcaattagcgcagaaaatggctgctgctgcagagaaggaggaggcccccgtagatcttcttgcgcaatacatgcaagtggaggctcatgactggcagaaccggcttagacaagctatactggggctaacgcttgcaatcccaaacccaattgtgggtttagcgataagtgggttcatccgcctcctttggccagcaaacaaggtaagtatttgggaggctctcaatgcggagcaatacattacgaacattgtccagcaggagctgatgcaattcgaaatgcggacacttcagtcccgaatcgaggcgctgcaaaccacaattcacagatacgatcaggccgctgcaactactgagaaggggaactttctaagtaactggatcactcaagctgatggtttgctttctagcatgcgcaattcttccaacaggatccaccttctccttcacattgtcaccgtggctgcgctccatatggcagctctgcatgagcgactgacttttggcgaggaactctacggcttaaacgatacagcaagttggcagcgagctctggtggaaatgtttgaggagtacacaaccgatttaatcccgaatgttttcagaaggtggaaggaatggaggccaacccagatcgagattacaacatgggtacgcaggggctcatgcggcaatcttacttgtagaccagacgtttcttatgctacagtggaggacaagatctccggggcattattctcattccaggcaacaaatcgaaactcgacaacaattttctcagaagtttgcgaagaccacaaaactcgaatggtgaacgaggccattgcggacatggcgagctgcctgtcacccacttttgctttccacaagctcctacccgacgatattcagacgcagttctctccttacgatcggcagcaatttggacaggttttcagaggcccatattcccaggatctttcgcacggactctggacggttttcaaatccttcagatcgcgcacaacacgctctgatcagacacttcgcgatagaatcttggaggtgatcataagagcggggcaccatgttgatgctatacagttcgtgtacgatcatgtgaatccaaattctacgactccggggattgtggctggaaatgccgcgggaggaactaggcatcagattgatgtgagggatcggcccataaaggaagtgcgcatggagttctctcaggatgtgcttgcttcgttgcagctccattttgaggatggcacatcaacacggaaattcggcaatgaacttggttgggcgactagaatactaacttgtacagtgccctatggctacaggttcagctcatgggcctttcgtgaagatcccggcccctacagaacaaccgccatcagtgtactccgcttccaattcacccctgagctggattttcccttgtct

SEQ ID NO: 327 - DNA, 1536 bp, Artificial Sequence
  coding sequence for IPD113 chimeric protein
atggcagctaaggacgttaatactgtttctgagctagctcccgctgctgatcagaaggagcagaacgacgccacaggcatggccgaagaggacccaatttttgcgcaattagcgcagaaaatggctgctgctgcagagaaggaggaggcccccgtagatcttcttgcgcaatacatgcaagtggaggctcatgactggcataatcgacttagacaagctatactgggcctaacgcttgcaataccaaacccaattgtgggtttagcgataagcgggtttatccggctcatttggccagcaaacaaggtgagtatttgggaggctctgaatgcggagcaatacattaggaacattgtccagcaggagctgatgcagttcgaaatgcggacacttcagtcccaaatcgagacgctgcaaaccacaattcacagatacgatcaggccgctgcaattcctgagaaggggaactttctaagcaactggatctcgcaagctgatggtttgttctctagcatgcgcaactcttccaacagaatccatcttctccttcacattgtcaccgtggctacgctgcatatggcagctctgcatgagcgactgagttttggcaaggaactctacggcgtagacgatacagcaagttggaagcgagctctggagcaaatgtttgaggagtacacaaccgatttaatcccgaatgttttcagaaggtggaaggaatggaggccaacccagatcgagattacaacatgggtacgcaggggctcatgcggcaatcttacttgtagaccagacgtttcttatgctacagtggaggacaagatctccggggcattattctcattccaggcaacaaatcgaaactcgacaacaattttctcagaagtttgcgaagaccacaaaactcgaatggtgaacgaggccattgcggacatggcgagctgcctgtcacccacttttgctttccacaagctcctacccgacgatattcagacgcagttctctccttacgatcggcagcaatttggacaggttttcagaggcccatattcccaggatctttcgcacggactctggacggttttcaaatccttcagatcgcgcacaacacgctctgatcagacacttcgcgatagaatcttggaggtgatcataagagcggggcaccatgttgatgctatacagttcgtgtacgatcatgtgaatccaaattctacgactccggggattgtggctggaaatgccgcgggaggaactaggcatcagattgatgtgagggatcggcccataaaggaagtgcgcatggagttctctcaggatgtgcttgcttcgttgcagctccattttgaggatggcacatcaacacggaaattcggcaatgaacttggttgggcgactagaatactaacttgtacagtgccctatggctacaggttcagctcatgggcctttcgtgaagatcccggcccctacagaacaaccgccatcagtgtactccgcttccaattcacccctgagctggattttcccttgtct

SEQ ID NO: 328 - DNA, 1527 bp, Artificial Sequence
  coding sequence for IPD113 chimeric protein
atggcagctaaggacgttaatactgtttctgagctagctcccgctgctgatcagaaggagcagaacgacgccacaggcatggccgaagaggacccaatttttgcgcaattagcgcagaaaatggctgctgctgcagagaaggaggaggcccccgtagatcttcttgcgcaatacatgcaagtggaggctcatgactggcataaccggatcagaggcgccatactggggctgatatccttagtgccaaaggtgggtgctgctgtaagcaggctcatcggcctcttttggccagcaaacaaggtggacatttgggaggccctcaaggcggaggaatatatcaggaacattgtccagcaggagctttttgagttcgaaatgcggctccttcaggacgacatcgaagcgctggaaatgactgttgcgagatacgatagggctgcacttactgaaaaggggaactttctaagcatctggatctcgcaagctgatgcattgtatattcggatgcggaactctaccaacaacatccaccttctccttcacatggtcactgtgtctacacttcatatggcagccctgcatgagcgactgacatttggcgaggaactgtatggcacaaacaattcagcgaattggacgcaagatcttgtggacaagttcgagaggtacacaaccgatttaatcccgaatgttttcagaaggtggaaggaatggaggccaacccagatcgagattacaacatgggtacgcaggggctcatgcggcaatcttacttgtagaccagacgtttcttatgctacagtggaggacaagatctccggggcattattctcattccaggcaacaaatcgaaactcgacaacaattttctcagaagtttgcgaagaccacaaaactcgaatggtgaacgaggccattgcggacatggcgagctgcctgtcacccacttttgctttccacaagctcctacccgacgatattcagacgcagttctctccttacgatcggcagcaatttggacaggttttcagaggcccatattcccaggatctttcgcacggactctggacggttttcaaatccttcagatcgcgcacaacacgctctgatcagacacttcgcgatagaatcttggaggtgatcataagagcggggcaccatgttgatgctatacagttcgtgtacgatcatgtgaatccaaattctacgactccggggattgtggctggaaatgccgcgggaggaactaggcatcagattgatgtgagggatcggcccataaaggaagtgcgcatggagttctctcaggatgtgcttgcttcgttgcagctccattttgaggatggcacatcaacacggaaattcggcaatgaacttggttgggcgactagaatactaacttgtacagtgccctatggctacaggttcagctcatgggcctttcgtgaagatcccggcccctacagaacaaccgccatcagtgtactccgcttccaattcacccctgagctggattttcccttgtct

SEQ ID NO: 329 - DNA, 1527 bp, Artificial Sequence
  coding sequence for IPD113 chimeric protein
atggcagctaaggacgttaatactgtttctgagctagctcccgctgctgatcagaaggagcagaacgacgccacaggcatggccgaagaggacccaatttttgcgcaattagcgcagaaaatggctgctgctgcagagaaggaggaggcccccgtagatcttcttgcgcaatacatgcaagtggaggctcatgactggcataaccggacgagaggtgccgtactggggatcatatccgcaataccgaaggtgggtgctgccataagcatgctcatcggcctgttttggccagcgaacaaggttgatatctgggtggccctcaatgcggaggaatatgttagaaacattgtcaggcaggagattttcgaattcgaaatgcagcaacacaagtccgaaatcgaggcgttggaagccgctatttccagatacgatacggttgcgcttactgagaagggaaattttctaagcatctggatctggcaagctgacagactgtgtattcagctgcgaaactccgccaacagaatccaccttctccttcacatagtcaccgtggctgtgcttcatatcgccgccatgcatgagcgatttacatttggcgaggagatctacggcacaaacaatacagcagcttggaggaaagattttgtggatgtgttcgagatgtacacaaccgatttaatcccgaatgttttcagaaggtggaaggaatggaggccaacccagatcgagattacaacatgggtacgcaggggctcatgcggcaatcttacttgtagaccagacgtttcttatgctacagtggaggacaagatctccggggcattattctcattccaggcaacaaatcgaaactcgacaacaattttctcagaagtttgcgaagaccacaaaactcgaatggtgaacgaggccattgcggacatggcgagctgcctgtcacccacttttgctttccacaagctcctacccgacgatattcagacgcagttctctccttacgatcggcagcaatttggacaggttttcagaggcccatattcccaggatctttcgcacggactctggacggttttcaaatccttcagatcgcgcacaacacgctctgatcagacacttcgcgatagaatcttggaggtgatcataagagcggggcaccatgttgatgctatacagttcgtgtacgatcatgtgaatccaaattctacgactccggggattgtggctggaaatgccgcgggaggaactaggcatcagattgatgtgagggatcggcccataaaggaagtgcgcatggagttctctcaggatgtgcttgcttcgttgcagctccattttgaggatggcacatcaacacggaaattcggcaatgaacttggttgggcgactagaatactaacttgtacagtgccctatggctacaggttcagctcatgggcctttcgtgaagatcccggcccctacagaacaaccgccatcagtgtactccgcttccaattcacccctgagctggattttcccttgtct

SEQ ID NO: 330 - DNA, 1527 bp, Artificial Sequence
  coding sequence for IPD113 chimeric protein
atggcagctaaggacgttaatactgtttctgagctagctcccgctgctgatcagaaggagcagaacgacgccacaggcatggccgaagaggacccaatttttgcgcaattagcgcagaaaatggctgctgctgcagagaaggaggaggcccccgtagatcttcttgcgcaatacatgcaagtggaggctcatgactggcataatcggacgcgagatgttgtgctggcgctgatatccataatcccgacagtgggtgctatcgcaagcgtggtcctcggcatcttctggccagcaaacaaggtggacatttgggtggccctcagcctggaggaatatgttagaaacatcgtgaagcaggagattttcgaattcgagatgcggcagcatcagtcctccatcgaggcactggaatccactattcggagatacaatacggctgcccttcctgaaaaggggaattttctaagcatctggatctcgcaagctgacgcgctgtgtattcggttgcggaactctaccaacgacatccaccttctccttcacattgtcaccgtgtctgtgcttcatatggccgccatgcatgagcgactcacatttggcgaggaactctacggcacagacaatacagcaaattggacgcgagaccttgtggaggtgttccagatgtacacaaccgatttaatcccgaatgttttcagaaggtggaaggaatggaggccaacccagatcgagattacaacatgggtacgcaggggctcatgcggcaatcttacttgtagaccagacgtttcttatgctacagtggaggacaagatctccggggcattattctcattccaggcaacaaatcgaaactcgacaacaattttctcagaagtttgcgaagaccacaaaactcgaatggtgaacgaggccattgcggacatggcgagctgcctgtcacccacttttgctttccacaagctcctacccgacgatattcagacgcagttctctccttacgatcggcagcaatttggacaggttttcagaggcccatattcccaggatctttcgcacggactctggacggttttcaaatccttcagatcgcgcacaacacgctctgatcagacacttcgcgatagaatcttggaggtgatcataagagcggggcaccatgttgatgctatacagttcgtgtacgatcatgtgaatccaaattctacgactccggggattgtggctggaaatgccgcgggaggaactaggcatcagattgatgtgagggatcggcccataaaggaagtgcgcatggagttctctcaggatgtgcttgcttcgttgcagctccattttgaggatggcacatcaacacggaaattcggcaatgaacttggttgggcgactagaatactaacttgtacagtgccctatggctacaggttcagctcatgggcctttcgtgaagatcccggcccctacagaacaaccgccatcagtgtactccgcttccaattcacccctgagctggattttcccttgtct

SEQ ID NO: 331 - DNA, 1578 bp, Artificial Sequence
  mutagenesis template codon optimized
atggactctgacctgatcgcgcagccgccggacgacaacgcggcgtctgttggtgcgccggcagctgagaaagttcaagaagatcagctggttgttaccactcctgaaatggaggacagcgacgtcgacccccaattcgaacaagaaatgataaacatatcggcgctgatagctgctggtgcagtagaggggcacgacgacgtagatctttttgccaaatacatgcaagtggaggctcatgactggcagaaccggctcagacaggccatactggggctgacactcgcaataccgaacccgatagtgggtcttgctataagcgggttcatccgcctcctttggccagcaaacaaggtgagcatttgggaggccctcaacgcggagcaatatatcacgaacattgtccagcaggagcttatgcaattcgaaatgcggacccttcagagccgcatcgaagcgctgcaaaccactattcacagatacgatcaggctgcagctactacagaaaaggggaactttctgagcaactggatcacgcaagctgatgggttgcttagttcgatgcgaaactcttccaaccgcatccaccttctccttcacatagtcaccgtggctgcacttcatatggcagccctgcatgagcgactgacatttggcgaggaactgtatggcttaaacgatacggcgagttggcagcgagctcttgtggaaatgttcgaggagtacacaatcaaattaatcccgactattttcaaagagtggaggccatggagggaacgccagatcgagattaacgaatggagacagaggggccagtccggcgttactatctttagaccagactcttctcatgctacagtgcaggacaagctctccggggaattattcacatttcgggtaaactatcaatactcgacaacaattttctcaggagttaccagagaccacagaactcggatgataaacgaggccattgcggacatggcgagctgcatatcacccacttttgctctccacatgctcctacccgacgatgttaagacgcggttctctccttacgatcgggggctgttcggacgggtttccagaggcccatattcccaggatcttttgcagcaactcttcacgtctgtcaaagacttcagatcgcacccaagacgctttgatcagacagctcgcgatagagtcgtgaaggtgatcataagagcggggcaccatgttgatgctatacagttctggtacgatcatgtaaattcaaattctacgactacggggattatggctggaaactcctcgggaggaattaggcatgagattgatgtgaaggatcgacccatacacgaattgcgcatggagttctctcacaatgtgcttgcttcgttgcagctccattttcaggatggtacagcaacacagaaattcggcaatgtaaatggttgggcgtctagaatagcgacttgtacagcgccctatagctacaagctcagctcatgggcctttcgtgaagatcccggcccctacaacacaaccgccatcagtgtactccgcttcgacttcacccccgaggacccttcgtcc

SEQ ID NO: 332 - DNA, 57 bp, Artificial Sequence
  cloning primer
cgaaatctctcatctaagaggctggatcctaggatggattccgatctgattgctcag

SEQ ID NO: 333 - DNA, 55 bp, Artificial Sequence
  cloning primer
gttggccaatccagaagatggacaagtctagatcatgatgagggatcttcaggtg

SEQ ID NO: 334 - protein, 5 aa, Artificial Sequence
  fusion linker
EEKKN

SEQ ID NO: 335 - DNA, 1356 bp, Asplenium pellucidum
atgcaggtcgaggttcatgactggaataaccggcttagaaaagctgtactggcgctaacatccgagatcccaatggtgggttttgcgataagtgggctcatcggcctcttctggccaaaaaacaaggtgagtatttgggaggccctcaaagtggagcaatatgttaggaacattgttcagcaggagctgttcgaattcgaaatggggctacttgagtccgacatcgaggcgctgcaaaccaccattcacagatacgatcaggccgctgcaacgcttgagaaggggaattttctgagcatctggatctcccaagctgacggcttgcttattcgcatgcgccgttctaccaacaacatccaccttctccttcacattgtgaccgtggctgtgctccatatggcagctctgcatgagcgactgacctttggcgaagaactctacggctcaaacaatacagcaaattggaagcaagctctggtgcaaatgtttgaggagtacacagtcaatttaatcccgactgtctttaaggagtggaggcagtggcgggatagccagattgagattaaacaatgggccaagaggggtcaatggggcactgttgtttctagtccagactcttcgcatgctactgtggaggacaagctcgcaggtgaactgttcacgtttagtaggagctatctatactcgaccacaattttctcaggagtgaccggagatcagaagacgcggatgatgaatgaggccactgcggacatggctagctgcatgtcacccacttttgctttccacgagctcctacccgacgatgtcaagaaacagttttctccttataacaaggagctatttggccgggtgttcagaggcccatattctcaggatcttatgcagccacttttcacgaatatcaacaaagacttcagatcgcatccaaaacgttttgatcagacggctcgtgacagagtcttggaggtgactataagggcagggcaccatattgatgctatacagttttggtacgatcatacgaatgcaaattctacaactgcaggcctgatggcagggaattctagcggggggagtaggcatcagattgatgtgagggaccggcccatagaggagttgcgcatggagtttgctcacgacacgctcgcttcattgcagctccatttccgagatggtacagcaacgaagaggtacggcaatgaacttggttgggcgtctaaaatagccacatgcacagccccctttggctacaagctcagctcatgggcctttcgtgaagatcctggcttctacaacaccactgccatcagtgtacttcgctttgatttcactcccgaagatccatctgcatat

SEQ ID NO: 336 - DNA, 1356 bp, Asplenium laserpitiifolium
atgcaggtcgaggttcatgactggaataaccggcttagaaaagctgtactggcgctaacatccgagatcccaacggtgggttttgcgataagtgggctcatcggcctcttctggccaaaaaacaaggtgagtatttgggaggccctcaaagtggagcaatatgttaggaacattgttcagcaggagctgttcgaattcgaaatggggctacttgagtccgacatcgaggcgctgcaaaccaccattcacagatacgatcaggccgctgcaacgcttgagaaggggaattttctgagcatctggatctcccaagctgacggcttgcttattcgcatgcgccgttctaccaacaacatccaccttctccttcacattgtgaccgtggctgtgctccatatggcagctctgcatgagcgactgacctttggcgaagaactctacggctcaaacaatacagcaaattggaagcaagctctggtgcaaatgtttgaggagtacacagtcaatttaatcccgactgtctttaaggagtggaggcagtggcgggatagccagattgagattaaacaatgggccaagaggggtcaatggggcactgttgtttctagtccagactcttcgcatgctactgtggaggacaagctcgcaggtgaactgttcacgtttagtaggagctatctatactcgaccacaattttctcaggagtgaccggagatcagaagacgcggatgatgaatgaggccactgcggacatggctagctgcatgtcacccacttttgctttccacgagctcctacccgacgatgtcaagaaacagttttctccttataacaaggagctatttggccgggtgttcagaggcccatattctcaggatcttatgcagccacttttcacgaatatcaacaaagacttcagatcgcatccaaaacgttttgatcagacggctcgtgacagagtcttggaggtgactataagggcagggcaccatattgatgctatacagttttggtacgatcatacgaatgcaaattctacaactgcaggcctgatggcagggaattctagcggggggagtaggcatcagattgatgtgagggaccggcccatagaggagttgcgcatggagtttgctcacgacacgctcgcttcattgcagctccatttccgagatggtacagcaacgaagaggtacggcaatgaacttggttgggcgtctaaaatagccacatgcacagccccctttggctacaagctcagctcatgggcctttcgtgaagatcctggcttctacaacaccactgccatcagtgtacttcgctttgatttcactcccgaagatccatctgcatat

SEQ ID NO: 337 - DNA, 1587 bp, Asplenium laserpitiifolium
atggattccgatacgattgctcagccacgtgaactcaacactgcttctgtgggtgcatcggctgcagagaaggttcagcaggatcagttggacgtagtggccacgccagaaatgcagggggattcagacgtcgatccacaattcgaacaggaatcgatcaatctctctgcgcttatcgcggctggtgcagtggaggggcacgacgacgtagatcttttcgctaaatacatggaggtcgaggctcatgactggattaaccggcttcgagaagctattctgggtctaacggctttcatcccaaacgtggttgtgggtttagcgataaatgggttcatccgcctgctttggccaccaaacaaggtaagcatttgggaggctatcaatgcggagcaacacgttcggaacattgtccagcgggagctgatggaatttgaaatgcggacacttcagtccagcattgaggcgctggaaaccacaattcacagatatgatcaggccgcttcaaccaccgagaaggggaattttctaagcagctggatcacgcaagctgatattttgttttctcgcatgcgcaattctcccaataggatccaccttcaacttcacatcgtcaccgtggcggcgctccatatggcagctctgcatgagcgactgacttttggcgaggaactctacggcttagacgatacagcagcttggaagcgagctcttgtggacatgttcgaggagtacacggtcaaattaatcccgactgtctttaaggagtggaggccgtggcgggagagccagattgagatcagcgaatggagacggaggggtcaatcgggcaatcttatttttcgtccagacgtttcgtctgctactgtagaggataagctctcaggggaactgttcacatttcgggtgaattatcaatactccacaacagttttctctggagtgaccagggaccatcgcactcggatgatgaatgaggcagttgctgacatggatagctgcatatcgcccactttcgctctccacaagctcctacccgatgatgtcaagatacggttttctccttacgacagacaggtattcggtcgcgtgagcagaggcccatattctcaagaccttcgtcagcagcagttcacgagagtcaaagacttcagatcgcatccaagacgctttgatcagacggctcgagacagagtcttgcaggtgaatataagagcgcagaaccacgttcatgctctacagtttttgtacgatcacgcgaatcccaattctacaactgcaggcattattgccgggagttttacgtcgggggggactacgaataggataaacgtgaggacgcggcccatacagaagctgcgcatggagtttgctcaggatgtgctcgcttcattgcaacttcatttccaagacggtacatcaacgcagaaatttggcaatataaatggttgggcatctacaatagccacttgcacagcccccaatggctacaagctcagctcatgggcctttcatgaggatcccggtcccaatgggacgccagccattaatgtacttcgctttgatttcacacctgaagatccctcatca

SEQ ID NO: 338 - DNA, 1587 bp, Asplenium laserpitiifolium
atggattccgatacgattgctcagccacgtgaactcaacactgcttctgtgggtgcatcggctgcagagaaggttcagcaggatcagttggacgtagtggccacgccagaaatgcagggggattcagacgtcgatccacaattcgaacaggaatcgatcaatctctctgcgcttatcgcggctggtgcagtggaggggcacgacgacgtagatcttttcgctaaatacatggaggtcgaggctcatgactggattaaccggcttcgagaagctattctgggtctaacggctttcatcccaaacgtggttgtgggtttagcgataaatgggttcatccgcctgctttggccaccaaacaaggtaagcatttgggaggctatcaatgcggagcaacacgttcggaacattgtccagcgggagctgatggaatttgaaatgcggacacttcagtccagcattgaggcgctggaaaccacaattcacagatatgatcaggccgcttcaaccaccgagaaggggaattttctaagcagctggatcacgcaagctgatattttgttttctcgcatgcgcaattctcccaataggatccaccttcaacttcacatcgtcaccgtggcggcgctccatatggcagctctgcatgagcgactgacttttggcgaggaactctacggcttagacgatacagcagcttggaagcgagctcttgtggacatgttcgaggagtacacggtcaaattaatcccgactgtctttaaggagtggaggccgtggcgggagagccagattgagatcagcgaatggagacggaggggtcaatcgggcaatcttatttttcgtccagacgtttcgtctgctactgtagaggataagctctcaggggaactgttcacatttcgggtgaattatcaatactccacaacagttttctctggagtgaccagggaccatcgcactcggatgatgaatgaggcagttgctgacatggatagctgcatatcgcccactttcgctctccacaagctcctacccgatgatgtcaagatacaattttctccttacgacagacaggtattcggtcgcgtgagcagaggcccatattctcaagaccttcgtcagcagcagttcacgagagtcaaagacttcagatcgcatccaagacgctttgatcagacggctcgagacagagtcttgcaggtgaatataagagcgcagaaccacgttcatgctctacagtttttgtacgatcacgcgaatccaaattctacaactgcaggcattattgccgggagttttacgtcgggggggactacgaataggataaacgtgaggacgcggcccatacagaagctgcgcatggagtttgctcaggatgtgctcgcttcattgcaacttcatttccaagacggtacatcaacgcagaaatttggcaatataaatggttgggcatctacaatagccacttgcacagcccccaatggctacaagctcagctcatgggcctttcgtgaggatcccggtcccaatgggacgccagccattagtgtacttcgctttgatttcacacctgaagatccctcatca

SEQ ID NO: 339 - DNA, 1245 bp, Asplenium laserpitiifolium
atggattccgatacgattgctcagccacgtgaactcaacactgcttctgtgggtgcatcggctgcagagaaggttcagcaggatcagttggacgtagtggccacgccagaaatgcagggggattcagacgtcgatccacaattcgaacaggaatcgatcaatctctctgcgcttatcgcggctggtgcagtggaggggcacgacgacgtagatcttttcgctaaatacatggaggtcgaggctcatgactggattaaccggcttcgagaagctattctgggtctaacggctttcatcccaaacgtggttgtgggtttagcgataaatgggttcatccgcctgctttggccaccaaacaaggtaagcatttgggaggctatcaatgcggagcaacacgttcggaacattgtccagcgggagctgatggaatttgaaatgcggacacttcagtccagcattgaggcgctggaaaccacaattcacagatatgatcaggccgcttcaaccaccgagaaggggaattttctaagcagctggatcacgcaagctgatattttgttttctcgcatgcgcaattctcccaataggatccaccttcaacttcacatcgtcaccgtggcggcgctccatatggcagctctgcatgagcgactgacttttggcgaggaactctacggcttagacgatacagcagcttggaagcgagctcttgtggacatgttcgaggagtacacggtcaaattaatcccgactgtctttaaggagtggaggccgtggcgggagagccagattgagatcagcgaatggagacggaggggtcaatcgggcaatcttatttttcgtccagacgtttcgtctgctactgtagaggataagctctcaggggaactgttcacatttcgggtgaattatcaatactccacaacagttttctctggagtgaccagggaccatcgcactcggatgatgaatgaggcagttgctgacatggatagctgcatatcgcccactttcgctctccacaagctcctacccgatgatgtcaagatacggttttctccttacgacagacaggtattcggtcgcgtgagcagaggcccatattctcaagaccttcgtcagcagcagttcacgagagtcaaagacttcagatcgcatccaagacgctttgatcagacggctcgagacagagtcttgcaggcattattgccgggagttttacgtcgggggggactacgaatagga

SEQ ID NO: 340 - DNA, 1509 bp, Hymenasplenium unilaterale
atggcagctgcgcccggcatgaaggactcagaaatgatcgctgacgtcgtcactactactgtttctgtgcctgctggtggggaggtgccgctggacctggatgaattggggcgtactgcggtcaccaataacaatatagatgtgcttgccaaatacatgcaaatggaggctcatgactggcataaccgggtgagagacgctgtactggggctcataggcgcagtctcggtggtgggttatgccgtaagcaagctcatcggcttgttttggccagcgaacaaggttgacatttgggaggccctcaaactggaggaatatgttaaaaacattgtcaagcgggagatttttgaattcgaaatgcagcaacttgagtccgaagtcgaggcgctggagctcactatttccagatacgacaaggctgcgcttcgtgagaagggaaattttctgagcatttggatctcgcgagccgacagattgattattctattgcgaaactctaccaacaacatccaccttctccttcacattgtcaccgtgtctgtgcttcatatggccgccatgcatgagcggctgacattcggcgaggaactctatggcacaaacaatacagagaattggacgaaagatcttgtgcaagtgtacgagatgtacacatcccatataatcccagatatcttcaagaagtggagcgagtggagggaaacccaaattgagattaaagcatgggcagtaaaggaaaaatggggaaataattcttccagaccagcagtttcccatgcaacagtggaggataagatctcaggggagaaaatagaatttcggagatcggggatatactcaacaacaatattcttagatgctgcccaagatcacaaaactcggatgttgaatgaggccattgcagacatgaacagctgcttgtcacccacttttgattttcacaagctcctacccaacaatattcgaacacgattcttgccttatgataaagagctattcggacaagtctttcgaggcccatattcacaagatcttttacaatcactcttcaccgatgttaagtccttcagaacacgtccaactcactttgatcaaatagctcacgacaaaatcttggaggtgactataggagaagggcaccacgttcatgctctacagtttttgtatgatcagcaggagaatccagaacctatgactgcagggtctatggtcacaaactctaccgggggtagtaggcaccaagttgatttgaggaatcgtcacatacatgatttgcgcttagagttctctcaggatgtgcttgcttcattgcaacttcgttttgaagatggtacatcaacacaaaaattcggcaatgaattgggttgggctaccaatatagtaacttgtacaaccccctctggctataggctaagctcatgggcctttcgtgaagatcccggtccctacaatacaaccgccatcagtgtaatccgtttccaattcacccctaatgaggaccccttgtca

SEQ ID NO: 341 - DNA, 1515 bp, Pellaea ovata
atggcaactgaggacgttaatgctgttgctccgcctgctgaggaggtgcaggccgccatgggtgccgaggaggacccggttttctcacaattagcgcagaagatggtcgctgctgttgcggaggggcaggacgtccccgttgatcttcttgcccaatacatgcaagtggaggctcatgactggcataaccggattagaggcgccatactggggctgctatctgcagtgcccaaggtgggtactgccataagcatgctcattggcctcttttggccagcaaacagggtggacatttgggaggccatcaatgcagaggaatatattcggaacattgtgcagcaggagatcttcgagttcgaattgcagctacttcggggcgacatccaagcgctggaaaccactgttgctagatacgatacggctgcgcttactgagaaggggaatttcctaagcatctggatctcgcaagctgacgcattgtatattcggatgcgaaactctgccaacaacatccaccttctccttcacattgtcaccgtgtctacgcttcatctcgcagccctgcatgagcgactgacatttggcgaggaactctacggctcaaacaatacagcaaactggacgcaagatcttgtggataagttcgaggtgtacacaaccgatctaatcccaaatatcttcaaaaggtggaaggactggagggaaacccagattgagattacagcatgggtacgcaggggctcatgtggcaatcttacgtgtagaccaaacgtgtcttttgcaacagtcgaggataagatctccggggcgcgattctcgtttcaggcaacgaatcgaaactcaacaacaattttctcaggaatctgcgaagatcacaaaactcggatggtgaacgaggccattgctgacatggccagctgcctgtcacccacttttgcttttcacaagctcctacccaaagatattcagacgcggttctctccttacgatagggagcagttcggacgggttttcaggggcccatattcccaggatctttcgcacggagcctggacggctctcaaagccttccggtcgcatccaactcgctttgatcagacaactcgcgacagaatcttggaggtgatcataagagcgggccaccatgtggatgctatacaattctggtacgatcatgtgaatccaaatgctgtgactgcagggaccatggctggaaaccccatgggagggaacaggcatcaaattgatgtgaggaatcgacccatacacgaactgcgcatggagttcgctcatgacattcttgcttcattgcaacttcatttcgaagatggcacatcaacacgaagattgggcaatacgcccggttgggcgtctagaatcgcaacttgtacagccccctatggctacaggttcagctcctgggccttccgcgaagatcccggcccctacggaacaaccgccatcagtgtactgcgcttccaattcacccccgagctggagatgccgttgcctgca

SEQ ID NO: 342 - DNA, 1515 bp, Pellaea ovata
atggcaactgaggacgttaatgctgttgctccgcctgctgaggaggtgcaggccgccatgggtgccgaggaggacccggttttctcacaattagcgcagaagatggccgctgctgttgcggaggggcaggacgtccccgttgatcttcttgcccaatacatgcaagtggaggctcatgactggcataaccggattagaggcgccatactggggctgatatctgcagtgcccaaggtgggtactgccataagcatgctcattggcctcttttggccagcaaacaaggtggacatttgggaggccctcaatgcagaggaatatattcggaacattgtgcagcaggagatcttcgagttcgaattgcagctacttcggaacgacatcgaagcgctggaaaccactgttgctagatacgatatggctgcgcttactgagaaggggaattttctaagcatctggatctcgcaagctgacgcattgtatattcggatgcgaaactctgccaacaacatccaccttctccttcacattgtcaccgtgtctacacttcatctcgcagccctgcatgagcgactgacatttggcgaggaactctacggctcaaacaatacagcaaactggacgcaagagcttgtggataagttcgaggtgtacacaaccgatctaatcccaaatatcttcaaaaggtggaaggactggagggaaacccagattgagattagagcatgggtacacaggggctcatgtggcaatcttatgtgtagaccagacgtgtcttttgctacagtcgaggataagatctccggggcgctattctcgtttcaggcatcgaatcgaaactcaacaacaattttctcaggaatttgcgaagatcacaaaactcggatggtgaatgaggccattgctgacatggccagctgcctgtcacccacttttgcttttcacaagctcctacccgaagatattcagacgcggttctctccttacgatagggagcagttcggacgggttttcagaggcccatattcccaggatctttcgcacggagcctggacggttctcaaagccttccggtcgcatccaactcgctttgatcatccaactcgcgacagaatcttggaggtgatcataagagcgggccaccatgtggatgctatacaattctggtacgatcatgtgaatccaaatgcggtgactgcggggaccatagctggaaattccatgggagggaacaggcatcaaattgatgtgaggaatcgacccatacacgaactgcgcatggagttctctcatgacattcttgcttcattgcaacttcatttcgaaaatggcacatcaacacaaagatttggcaatgagctcggttgggcgtccagaatcgcaacttgtacagccccctatggctacaggttcagctcctgggccttccgcgaagatcccggcccctacggaacaaccgccatcagtgtactgcgcttccaattcacccccgagctggagatgccgttgcctgca

SEQ ID NO: 343 - DNA, 1509 bp, Pellaea ovata
atggcaactgaggacgttaatgctgttgctccgcctgctgaggaggccgccatgggtgccgaggaggacccggttttctcacaattagcgcagaagatggccgctgctgttgcggaggggcaggacgtccccgttgatcttcttgcccaatacatgcaagtggaggctcatgactggcataaccggattagaggcgccatactggggctgatatctgcagtgcccaaggtgggtactgccataagcatgctcattggcctcttttggccagcaaacaaggtggacatttgggaggccctcaatgcagaggaatatattcggaacattgtgcagcaggagatcttcgagttcgaattgcagctacttcggaacgacatcgaagcgctggaaaccactgttgctagatacgatatggctgcgcttactgagaaggggaattttctaagcatctggatctcgcaagctgacgcattgtatattcggatgcgaaactctgccaacaacatccaccttctccttcacattgtcaccgtgtctacacttcatctcgcagccctgcatgagcgactgacatttggcgaggaactctacggctcaaacaatacagcaaactggacgcaagagcttgtggataagttcgaggtgtacacaaccgatctaatcccaaatatcttcaaaaggtggaaggactggagggaaacccagattgagattagagcatgggtacacaggggctcatgtggcaatcttatgtgtagaccagacgtgtcttttgctacagtcgaggataagatctccggggcgctattctcgtttcaggcatcgaatcgaaactcaacaacaattttctcaggaatttgcgaagatcacaaaactcggatggtgaatgaggccattgctgacatggccagctgcctgtcacccacttttgcttttcacaagctcctacccgaagatattcagacgcggttctctccttacgatagggagcagttcggacgggttttcagaggcccatattcccaggatctttcgcacggagcctggacggttctcaaagccttccggtcgcatccaactcgctttgatcatccaactcgcgacagaatcttggaggtgatcataagagcgggccaccatgtggatgctatacaattctggtacgatcatgtgaatccaaatgcggtgactgcggggaccatagctggaaattccatgggagggaacaggcatcaaattgatgtgaggaatcgacccatacacgaactgcgcatggagttctctcatgacattcttgcttcattgcaacttcatttcgaaaatggcacatcaacacaaagatttggcaatgagctcggttgggcgtccagaatcgcaacttgtacagccccctatggctacaggttcagctcctgggccttccgcgaagatcccggcccctacggaacaaccgccatcagtgtactgcgcttccaattcacccccgagctggagatgccgttgcctgca

SEQ ID NO: 344 - DNA, 1509 bp, Pellaea ovata
atggcaactgaggacgttaatgctgttgctccgcctgctgaggaggccgccatgggtgccgaggaggacccggttttctcacaattagcgcagaagatggccgctgctgttgcggaggggcaggacgtccccgttgatcttcttgcccaatacatgcaagtggaggctcatgactggcataaccggattagaggcgccatactggggctgatatctgcagtgcccaaggtgggtactgccataagcatgctcattggcctcttttggccagcaaacaaggtggacatttgggaggccctcaatgcagaggaatatattcggaacattgtgcagcaggagatctttgagttcgaattgcagctacttcggaacgacatcgaagcgctggaaaccactgttgctagatacgatatggctgcgcttactgagaaggggaattttctaagcatctggatctcgcaagctgacgcattgtatattcggatgcgaaactctgccaacaacatccaccttctccttcacattgtcaccgtgtctacgcttcatctcgcagccctgcatgagcgactgacatttggcgaggaactctacggctcaaacaatacagcaaactggacgcaagagcttgtggataagttcgaggtgtacacaaccgatctaatcccaaatatcttcaaaaggtggaaggactggagggaaacccagattgagattagagcatgggtacacaggggctcatgtggcaatcttatgtgtagaccagacgtgtcttttgctacagtcgaggataagatctccggggcgctattctcgtttcaggcatcgaatcgaaactcaacaacaattttctcaggaatttgcgaagatcacaaaactcggatggtgaatgaggccattgctgacatggccggctgcctgtcacccacttttgcttttcacaagctcctacccgaagatattcagacgcggttctctccttacgatagggagcagttcggacgggttttcagaggcccatattcccaggatctttcgcacggagcctggacggttctcaaagccttccggtcgcatccaactcgctttgatcatccaactcgcgacagaatcttggaggtgatcataagagcgggccaccatgtggatgctatacaattctggtacgatcatgtgaatccaaatgcggtgactgcggggaccatagctggaaattccatgggagggaacaggcatcaaattgatgtgaggaatcgacccatacacgaactgcgcatggagttctctcatgacattcttgcttcattgcaacttcatttcgaaaatggcacatcaacacaaagatttggcaatgagctcggttgggcgtccagaatcgcaacttgtacagccccctatggctacaggttcagctcctgggccttccgcgaagatcccggcccctacggaacaaccgccatcagtgtactgcgcttccaattcacccccgagctggagatgccgttgcctgca

SEQ ID NO: 345 - DNA, 1515 bp, Pellaea ovata
atggcaactgaggacgttaatgctgttgctccgcctgctgaggaggtgcaggccgccatgggtgccgaggaggacccggttttctcacaattagcgcagaagatggtcgctgctgttgcggaggggcaggacgtccccgttgatcttcttgcccaatacatgcaagtggaggctcatgactggcataaccggattagaggcgccatactggggctgatatctgcagtgcccaaggtgggtactgccataagcatgctcattggcctcttttggccagcaaacaaggtggacatttgggaggccctcaatgcagaggaatatattcggaacattgtgcagcaggagatcttcgagttcgaattgcagctacttcggaacgacatcgaagcgctggaaaccactgttgctagatacgatatggctgcgcttactgagaaggggaattttctaagcatctggatctcgcaagctgacgcattgtatattcggatgcgaaactctgccaacaacatccaccttctccttcacattgtcaccgtgtctacgcttcatctcgcagccctgcatgagcgactgacatttggcgaggaactctacggctcaaacaatacagcaaactggacgcaagagcttgtggataagttcgaggtgtacacaaccgatctaatcccaaatatcttcaaaaggtggaaggactggagggaaacccagattgagattagagcatgggtacacaggggctcatgtggcaatcttatgtgtagaccagacgtgtcttttgctacagtcgaggataagatctccggggcgctattctcgtttcaggcatcgaatcgaaactcaacaacaattttctcaggaatttgcgaagatcacaaaactcggatggtgaatgaggccattgctgacatggccagctgcctgtcacccacttttgcttttcacaagctcctacccgaagatattcagacgcggttctctccttacgatagggagcagttcggacgggttttcagaggcccatattcccaggatctttcgcacggagcctggacggttctcaaagccttccggtcgcatccaactcgctttgatcatccaactcgcgacagaatcttggaggtgatcataagagcgggccaccatgtggatgctatacaattctggtacgatcatgtgaatccaaatgcggtgactgcggggaccatagctggaaattccatgggagggaacaggcatcaaattgatgtgaggaatcgacccatacacgaactgcgcatggagttctctcatgacattcttgcttcattgcaacttcatttcgaaaatggcacatcaacacaaagatttggcaatgagctcggttgggcgtccagaatcgcaacttgtacagccccctatggctacaggttcagctcctgggccttccgcgaagatcccggcccctacggaacaaccgccatcagtgtactgcgcttccaattcacccccgagctggagatgccgttgcctgca

SEQ ID NO: 346 - DNA, 1515 bp, Pellaea ovata
atggcaactgaggacgttaatgctgttgctccgcctgctgaggaggtgcaggccgccatgggtgccgaggaggacccggttttctcacaattagcgcagaagatggtcgctgctgttgcggaggggcaggacgtccccgttgatcttcttgcccaatacatgcaagtggaggctcatgactggcataaccggattagaggcgccatactggggctgatatctgcagtgcccaaggtgggtactgccataagcatgctcattggcctcttttggccagcaaacaaggtggacatttgggaggccctcaatgcagaggaatatattcggaacattgtgcagcaggagatcttcgagttcgaattgcagctacttcggaacgacatcgaagcgctggaaaccactgttgctagatacgatatggctgcgcttactgagaaggggaattttctaagcatctggatctcgcaagctgacgcattgtatattcggatgcgaaactctgccaacaacatccaccttctccttcacattgtcaccgtgtctacacttcatctcgcagccctgcatgagcgactgacatttggcgaggaactctacggctcaaacaatacagcaaactggacgcaagagcttgtggataagttcgaggtgtacacaaccgatctaatcccaaatatcttcaaaaggtggaaggactggagggaaacccagattgagattagagcatgggtacacaggggctcatgtggcaatcttatgtgtagaccagacgtgtcttttgctacagtcgaggataagatctccggggcgctattctcgtttcaggcatcgaatcgaaactcaacaacaattttctcaggaatttgcgaagatcacaaaactcggatggtgaatgaggccattgctgacatggccagctgcctgtcacccacttttgcttttcacaagctcctacccgaagatattcagacgcggttctctccttacgatagggagcagttcggacgggttttcagaggcccatattcccaggatctttcgcacggagcctggacggctctcaaagccttccggtcgcatctaactcgctttgatcagacaactcgcgacagaatcttggaggtgatcataagagcgggccaccatgtggatgctatacaattctggtacgatcatgtgaatccaaatgctgtgactgcagggaccatggctggaaaccccatgggagggaacaggcatcaaattgatgtgaggaatcgacccatacacgaactgcgcatggagttcgctcatgacattcttgcttcattgcaacttcatttcgaagatggcacatcaacacgaagattgggcaatacgcccggttgggcgtctagaatcgcaacttgtacagccccctatggctacaggttcagctcctgggccttccgcgaagatcccggcccctacggaacaaccgccatcagtgtactgcgcttccaattcacccccgagctggagatgccgttgcctgca

SEQ ID NO: 347 - DNA, 1509 bp, Pellaea ovata
atggcaactgaggacgttaatgctgttgctccgcctgctgaggaggccgccatgggtgccgaggaggacccggttttctcacaattagcgcagaagatggccgctgctgttgcggaggggcaggacgtccccgttgatcttcttgcccaatacatgcaagtggaggctcatgactggcataaccggattagaggcgccatactggggctgatatctgcagtgcccaaggtgggtactgccataagcatgctcattggcctcttttggccagcaaacaaggtggacatttgggaggccctcaatgcagaggaatatattcggaacattgtgcagcaggagatcttcgagttcgaattgcagctacttcggaacgacatcgaagcgctggaaaccactgttgctagatacgatatggctgcgcttactgagaaggggaattttctaagcatctggatctcgcaagctgacgcattgtatattcggatgcgaaactctgccaacaacatccaccttctccttcacattgtcaccgtgtctacgcttcatctcgcagccctgcatgagcgactgacatttggcgaggaactctacggctcaaacaatacagcaaactggacgcaagatcttgtggataagttcgaggtgtacacaaccgatctaatcccaaatatcttcaaaaggtggaaggactggagggaaacccagattgagattagagcatgggtacagaggggctcatgtggcaatcttatgtgtagaccagacgtgtcttttgctacagtcgaggataagatctccggggcactattctcgtttcaggcaacgaatcgaaactcaacaacaattttctcaggaatttgccaagatcacaaaactcggatggtgaacgaggccattgctgacatggccagctgcctgtcacccacttttgcttttcacaagctcctacccgaagatattcagacgcggttctctccttacgatagggagcagttcggacgggttttcagaggcccatattcccaggatctttcgcacggagcctggacggttctcaaagccttccggtcgcatccaactcgctttgatcagacaactcgcgacagaatcttggaggtgatcataagagcgggccaccatgtggatgctatacaattctggtacgatcatgtgaatccaaatgctgtgactgccgggaccatggctggaaactccatgggagggaacaggcatcaaattgatgtgaggaatcgacccatacacgaactgcgcatggagttctctcatgacattcttgcttcattgcaacttcatttcgaagatggcacatcaacacgaagatttggcaatgagctcggttgggcgtctagaatcgcaacttgtacagccccctttggctacaggttcagctcctgggccttccgcgaagatcccggcccctacggaacaaccgccatcagtgtactgcgcttccaattcacccccgagctggagatgccgttgcctgca

SEQ ID NO: 348 - DNA, 1515 bp, Pellaea ovata
atggcaactgaggacgttaatgctgttgctccgcctgctgaggaggtgcaggccgccatgggtgccgaggaggacccggttttctcacaattagcgcagaagatggtcgctgctgttgcggaggggcaggacgtccccgttgatcttcttgcccaatacatgcaagtggaggctcatgactggcataaccggattagaggcgccatactggggctgctatctgcagtgcccaaggtgggtactgccataagcatgctcattggcctcttttggccagcaaacagggtggacatttgggaggccatcaatgcagaggaatatattcggaacattgtgcagcaggagatcttcgagttcgaattgcagctacttcggagcgacatccaagcgctggaaaccactgttgctagatacgattcggctgcccttactgagaaggggaattttctaagcatctggatctcgcaagctgacgcattgtatattcggatgcgaaactctgccaacaacatccaccttctccttcacattgtcaccgtgtctacgcttcatctcgcagccctgcatgagcgactgacatttggcgaggaactctacggctcaaacaatacagcaaactggacgcaagatcttgtggataagttcgaggtgtacacaaccgatctaatcccaaatatcttcaaaaggtggaaggactggagggaaacccagattgagattacagcatgggtacgcaggggctcatgtggcaatcttacgtgtagaccaaacgtgtcttttgcaacagtcgaggataagatctccggggcgcgattctcgtttcaggcaacgaatcgaaactcaacaacaattttctcaggaatctgcgaagatcacaaaactcggatggtgaacgaggccattgctgacatggccagctgcctgtcacccacttttgcttttcacaagctcctacccaaagatattcagacgcggttctctccttacgatagggagcagttcggacgggttttcaggggcccatattcccaggatctttcgcacggagcctggacggctctcaaagccttccggtcgcatccaactcgctttgatcagacaactcgcgacagaatcttggaggtgatcataagagcgggccaccatgtggatgctatacaattctggtacgatcatgtgaatccaaatgctgtgactgcagggaccatggctggaaaccccatgggagggaacaggcatcaaattgatgtgaggaatcgacccatacacgaactgcgcatggagttcgctcatgacattcttgcttcattgcaacttcatttcgaagatggcacatcaacacgaagattgggcaatacgcccggttgggcgtctagaatcgcaacttgtacagccccctatggctacaggttcagctcctgggccttccgcgaagatcccggcccctacggaacaaccgccatcagtgtactgcgcttccaattcacccccgagctggagatgccgttgcctgca

SEQ ID NO: 349 - DNA, 1515 bp, Pellaea ovata
atggcaactgaggacgttaatgctgttgctccgcctgctgaggaggtgcaggccgccatgggtgccgaggaggacccggttttctcacaattagcgcagaagatggtcgctgctgttgcgaaggggcaggacgtccccgttgatcttcttgcccaatacatgcaagtggaggctcatgactggcataaccggattagaggcgccatactggggctgctatctgcagtgcccaaggtgggtactgccataagcatgctcattggcctcttttggccagcaaacagggtggacatttgggaggccatcaatgcagaggaatatattcggaacattgtgcagcaggagatcttcgagttcgaattgcagctacttcggggcgacatccaagcgctggaaaccactgttgctagatacgatacggctgcgcttactgagaaggggaatttcctaagcatctggatctcgcaagctgacgcattgtatattcggatgcgaaactctgccaacaacatccaccttctccttcacattgtcaccgtgtctacgcttcatctcgcagccctgcatgagcgactgacatttggcgaggaactctacggctcaaacaatacagcaaactggacgcaagatcttgtggataagttcgaggtgtacacaaccgatctaatcccaaatatcttcaaaaggtggaaggactggagggaaacccagattgagattacagcatgggtacgcaggggctcatgtggcaatcttacgtgtagaccaaacgtgtcttttgcaacagtcgaggataagatctccggggcgcgattctcgtttcaggcaacgaatcgaaactcaacaacaattttctcaggaatctgcgaagatcacaaaactcggatggtgaacgaggccattgctgacatggccagctgcctgtcacccacttttgcttttcacaagctcctacccaaagatattcagacgcggttctctccttacgatagggagcagttcggacgggttttcaggggcccatattcccaggatctttcgcacggagcctggacggctctcaaagccttccggtcgcatccaactcgctttgatcagacaactcgcgacagaatcttggaggtgatcataagagcgggccaccatgtggatgctatacaattctggtacgatcatgtgaatccaaatgctgtgactgcagggaccatggctggaaaccccatgggagggaacaggcatcaaattgatgcgaggaatcgacccatacacgaactgcgcatggagttcgctcatgacattcttgcttcattgcaacttcatttcgaagatggcacatcaacacgaagattgggcaatacgcccggttgggcgtctagaatcgcaacttgtacagccccctatggctacaggttcagctcctgggccttccgcgaagatcccggcccctacggaacaaccgccatcagtgtactgcgcttccaattcacccccgagctggagatgccgttgcctgca

SEQ ID NO: 350 - DNA, 1509 bp, Pellaea ovata
atggcaactgaggacgttaatgctgttgctccgcctgctgaggaggccgccatgggtgccgaggaggacccggttttctcacaattagcgcagaagatggccgctgctgttgcggaggggcaggacgtccccgttgatcttcttgcccaatacatgcaagtggaggctcatgactggcataaccggattagaggcgccatactggggctgatatctgcagtgcccaaggtgggtactgccataagcatgctcattggcctcttttggccagcaaacagggtggacatttgggaggccatcaatgcagaggaatatattcggaacattgtgcagcaggagatcttcgagttcgaattgcagctacttcggagcgacatccaagcgctggaaaccactgttgctagatacgatacggctgcgcttactgagaaggggaattttctaagcatctggatctcgcaagctgacgcattgtatattcggatgcgaaactctgccaacaacatccaccttctccttcacattgtcaccgtgtctacgcttcatctcgcagccctgcatgagcgactgacatttggcgaggaactctacggctcaaacaatacagcaaactggacgcaagatcttgtggataagttcgaggtgtacacaaccgatctaatcccaaatatcttcaaaaggtggaaggactggagggaaacccagattgagattagagcatgggtacagaggggctcatgtggcaatcttatgtgtagaccagacgtgtcttttgctacagtcgaggataagatctccggggcactattctcgtttcaggcaacgaatcgaaactcaacaacaattttctcaggaatttgccaagatcacaaaactcggatggtgaacgaggccattgctgacatggccagctgcctgtcacccacttttgcttttcacaagctcctacccgaagatattcagacgcggttctctccttacgatagggagcagttcggacgggttttcagaggcccatattcccaggatctttcgcacggagcctggacggttctcaaagccttccggtcgcatccaactcgctttgatcagacaactcgcgacagaatcttggaggtgatcataagagcgggccaccatgtggatgctatacaattctggtacgatcatgtgaatccaaatgctgtgactgccgggaccatggctggaaactccatgggagggaacaggcatcaaattgatgtgaggaatcgacccatacacgaactgcgcatggagttctctcatgacattcttgcttcattgcaacttcatttcgaagatggcacatcaacacgaagatttggcaatgagctcggttgggcgtctagaatcgcaacttgtacagccccctttggctacaggttcagctcctgggccttccgcgaagatcccggcccctacggaacaaccgccatcagtgtactgcgcttccaattcacccccgagctggagatgccgttgcctgca

SEQ ID NO: 351 - DNA, 1521 bp, Myriopteris myriophylla
atgaaggactcagaaatgaaggccgctgaggacgttaatactgtttctgtgcttgccccgcctgctgagaagctgcgccaggacgatgagttggtaatgacagcgcctgttgctgaggaggggcaggaggtccccgtggatcagtttgccaaatacatgcaaatcgaggctcatgactggcataaccggattagagaagctatcctgggcctgatatccgcagtcccgaaggtgggtgctgccgtaagcaagctcgtcagcatcttttggccagcaaacaaggtggacatttgggaggccctcaatgcagagcaatatgttaggaacattgtcctgcaggagctttttgagttcgaaatgttgcaacttcggtccgacattgaggcgctgcaaaccacagttgggagatacgatacggctgcgattactgagaaggggaattttctaagcatctggatcacacaagctgacagtttgtatattcggttacgaaactctaccaacaacattcaccttctccttcacattgtcaccgtggttgtgcttcatgtcgcagccctgcatgagcgactgacatttggcgaggaactctacggcacaaacaatacagaaaattggacaaaggatcttgtggatgtgttcgagaagtacacatcccatttaatcccaaatctcttcaagcagtggaagccgtggagggaaagccagattgagattaaagcatgggcagtaaggggctcatggggcaatcttactcaaaggccagacgtttctcatgctacagtggaggataagatctcgggggagaacttcacgtttcggttatcgggacggtactcaacgacagttttctcaggagtttgtgaagatcacaaaactcggatgggtaatgaggccattgcagacatggccagctgcttgtcacccacttttgcttttcacaagctgcttcccgacgatattcaggcgcagttctctccttatgataaggcgctctttgggcaggttttcagaggcccatattcccaagatcttttgcagacgtacagcactggtcaaacaagcttcagatcgagtccaattcgctttgatcagacaactcgcgacagaatcttggaggtgaccataagagcggggcaccatgttgatgctatacaattttggtacgaccatgtggattcaaatgctatgactgcagggactatggccggaaactctacagggggttctagccatcaggttaatgtgagggatcagcccatacaggaattgcgcatggagttctctcatcgcgtgcttgcttcgttgcaacttcattttgaagatggcacatcaacacggaaatttggcaatgagcttggttgggcgtctaatatagtaacttgtacagcccccataggctacaggctcagctcatgggcctttcgtgaagatgccggcccctacggaacactcggcatcagtctactccgcttccagttcaccccagaggatatctctacccaggcagccatgatttca

SEQ ID NO: 352 - DNA, 1521 bp, Myriopteris myriophylla
atgaaggactcagaaatgaaggccgctgaggacgttcatactgtttctgtgcttgccccgcctgctgagaagctgcgccaggacgatgagttggtaatgacagcgcctgttgctgaggaggggcaggaggtccccgtggatcagtttgccaaatacatgcaaatcgaggctcatgactggcataaccggattagagaagctatcctgggcctgatatccgcagtcccgaaggtgggtgctgccgtaagcaagctcgtcagcatcttttggccagcaaacaaggtggacatttgggaggccctcaatgcagagcaatatgttaggaacattgtcctgcaggagctttttgagttcgaaatgttgcaacttcggtccgacattgaggcgctgcaaaccacagttgggagatacgatacggctgcgattactgagaaggggaattttctaagcatctggatcacacaagctgacagtttgtatattcggttacgaaactctaccaacaacattcaccttctccttcacattgtcaccgtggctgtgcttcatgtcgcagccctgcatgagcgactgacatttggcgaggaactctacggcacaaacaatacagaaaattggacaaaggatcttgtggatgtgtttgagaagtacacatcccatttaatcccaaatctcttcaagcagtggaagccgtggagggaaagccagattgagattaaagcatgggcagtaaggggctcatggggcaatcttactcaaaggccagacgtttctcatgctacagtggaggataagatctcgggggagaacttcacgtttcggttatcgggacggtactcaacgacagttttctcaggagtttgcgaagatcacaaaactcggatgggtaatgaggccattgcagacatggccagctgcttgtcacccacttttgcttttcacaagctgcttcccgacgatattcaggcgcagttctctccttatgataaggcgctctttgggcaggttttcagaggcccatattcccaagatcttttgcagacgtacagcactggtcaaacaagcttcagatcgagtccaattcgctttgatcagacaactcgcgacagaatcttggaggtgaccataagagcggggcaccatgttgatgctatacaattttggtacgaccatgtggattcaaatgctatgactgcagggactatggccggaaactctacagggggttctagccatcaggttaatgtgagggatcagcccatacaggaattgcgcatggagttctctcatcgcgtgcttgcttcgttgcaacttcattttgaagatggcacatcaacacggaaatttggcaatgagcttggttgggcgtctaatatagtaacttgtacagcccccataggctacaggctcagctcatgggcctttcgtgaagatgccggcccctacggaacactcggcatcagtctactccgcttccagttcaccccagaggatatctctacccaggcagccatgatttca

SEQ ID NO: 353 - DNA, 1521 bp, Myriopteris myriophylla
atgaaggactcagaaatgaaggccgctgaggacgttaatactgtttctgtgcttgccccgcctgctgagaagctgcgccaggacgatgagttggtaatgacagcgcctgttgctgaggaggggcaggaggtccccgtggatcagtttgccaaatacatgcaaatcgaggctcatgactggcataaccggattagagaagctatcctgggcctgatatccgcagtcccgaaggtgggtgctgccgtaagcaagctcgtcagcatcttttggccagcaaacaaggtggacatttgggaggccctcaatgcagagcaatatgttaggaacattgtcctgcaggagctttttgagttcgaaatgttgcaacttcggtccgacattgaggcgctgcaaaccacagttgggagatacgatacggctgcgattactgagaaggggaattttctaagcatctggatcacacaagctgacagtttgtatattcggttacgaaactctaccaacaacattcaccttctccttcacattgtcaccgtggttgtgcttcatgtcgcagccctgcatgagcgactgacatttggcgaggaactctacggcacaaacaatacagaaaattggacaaaggatcttgtggatgtgttcgagaagtacacatcccatttaatcccaaatctcttcaagcagtggaagccgtggagggaaagccagattgagattaaagcatgggcagtaaggggctcatggggcaatcttactcaaaggccagacgtttctcatgctacagtggaggataagatctcgggggagaacttcacgtttcggttatcgggacggtactcaacgacagttttctcaggagtttgtgaagatcacaaaactcggatgggtaatgaggccattgcagacatggccagctgcttgtcacccacttttgcttttcacaagctgcttcccgacgatattcaggcgcagttctctccttatgataaggcgctctttgggcaggttttcagaggcccatattcccaagatcttttgcagacgtacagcactggtcaaacaagcttcagatcgagtccaattcgctttgatcagacaactcgcgacagaatcttggaggtgaccataagagcggggcaccatgttgatgctatacaattttggtacgaccatgtggattcaaatgctatgactgcagggactatggccggaaactctacagggggttctagccatcaggttaatgtgagggatcagcccatacaggaattgcgcatggagttctctcatcgcgtgcttgcttcgttgcaacttcattttgaagatggcacatcaacacggaaatttggcaatgagcttggttgggcgtctaatatagtaacttgtacagcccccataggctacaggctcagctcatgggcctttcgtgaagatgccggcccctacggaacactcggcatcagtctactccgcttccagttcaccccagaggatatctctaaccaggcagccatgatttca

SEQ ID NO: 354 - DNA, 1521 bp, Myriopteris myriophylla
atgaaggactcagaaatgaaggccgctgaggacgttaatactgtttctgtgcttgccccgcctgctgagaagctgcgccaggacgatgagttggtaatgacagcgcctgttgctgaggaggggcaggaggtccccgtggatcagtttgccaaatacatgcaaatcgaggctcatgactggcataaccggattagagaagctatcctgggcctgatatccgcagtcccgaaggtgggtgctgccgtaagcaagctcgtcagcatcttttggccagcaaacaaggtggacatttgggaggccctcaatgcagagcaatatgttaggaacattgtcctgcaggagctttttgagttcgaaatgttgcaacttcggtccgacattgaggcgctgcaaaccacagttgggagatacgatacggctgcgattactgagaaggggaattttctaagcatctggatcacacaagctgacagtttgtatattcggttacgaaactctaccaacaacattcaccttctccttcacattgtcaccgtggttgtgcttcatgtcgcagccctgcatgagcgactgacatttggcgaggaactctacggcacaaacaatacagaaaattggacaaaggatcttgtggatgtgttcgagaagtacacatcccatttaatcccaaatctcttcaagcagtggaagccgtggagggaaagccagattgagattaaagcatgggcagtaaggggctcatggggcaatcttactcaaaggccagacgtttctcatgctacagtggaggataagatctcgggggagaacttcacgtttcggttatcgggacggtactcaacgacagttttctcaggagtttgtgaagatcacaaaactcggatgggtaatgaggccattgcagacatggccagctgcttgtcacccacttttgcttttcacaagctgcttcccgacgatattcaggagcagttctctccttatgataaggcgctctttgggcaggttttcagaggcccatattcccaagatcttttgcagacgtacagcactggtcaaacaagcttcagatcgagtccaattcgctttgatcagacaactcgcgacagaatcttggaggtgaccataagagcggggcaccatgttgatgctatacaattttggtacgaccatgtggattcaaatgctatgactgcagggactatggccggaaactctacagggggttctagccatcaggttaatgtgagggatcagcccatacaggaattgcgcatggagttctctcatcgcgtgcttgcttcgttgcaacttcattttgaagatggcacatcaacacggaaatttggcaatgagcttggttgggcgtctaatatagtaacttgtacagcccccataggctacaggctcagctcatgggcctttcgtgaagatgccggcccctacggaacactcggcatcagtctactccgcttccagttcaccccagaggatatctctacccaggcagccatgatttca

SEQ ID NO: 355 - DNA, 1542 bp, Pyrrosia linearifolia
atggcagctgaggttactactgtttctgagcttgctcccgctgctgatgggaaggtgcagaacggagagatggccgaagaggacccaatttttgcgcaactagcgcagaagatggttgctgctgcagagaagggggaggcccccgtagatcttcttgcccaatacatgcaagtggaggctcatgactggcataaccgggtcagaggtgccatactggggctgatatccatggtgccaaaggtgggtgctgcgataagcaggctcatcggcctcttttggccagcaaacagggtagacatttgggaggccctcagggcggaggaatatatcaggaacattgtccaggaagagctttttgaattcgaaatgcggctccttcagaacgacattgaagcgctggaaaccactgttgggagatacgatacggctgcacttggtgaaaaggggaactttctaagcatctggatctcgcaagctgatgcattgtatattcggatgcggaactctaccaacaacatccaccttctccttcacatggtcaccgtgtctacgcttcatctcgcagccctgcatgagcgactgacatttggcgaggaactgtatggcacagacaattcagcgaattggacgcgagaccttgtggacaagttcgagcagtacacaaccgatttaatcccgaatgttttccaaaggtggaaggaatggagaccaacccagatccagattacagcacgacgacagaggggctcatgcggcgttgttacctgtagaccaaacgtttcctttgctacagtggaggacaagatctccggggcaatattctcatttcaggcaacaaatcattactcgttaacaattttctcagaagtttgcgaagaccacaaaactcggatggtgaacgaggccgttgcggacatggcaagctgcctgtcaccaacttttgcttttcacaagctcctacctgacaatattcaggggcagttctctccttacgatcggcggcagttcggacaggttttcagaggcccatattcccaggacctttcgcacggactctggacagttttcaaatccttcagatcgcgcacaacacgctctgatcagacacttcgtgatagaatcgtgcaggtgatcataagagcggggtcccatgttgatgctatacagttcgtgtacgatcatgcgaatccaaattctacgactccggggattatggctggaaacgccgctggaggaattaggcatcaggttgatgtgaggaatcggcccatacaggaagtgcgcatggagtttgcgcgggatgtgcttgcttcggtgcagctccatttcgaggatggtacatcatcacagaaattcggcaatgaactttttggtacttgggcgactagagtactaacttgtacagcgccctatggctatagattcagctcatgggcctttcgtgaagatcccggcccctacagaacaactgccatcagtgtactccgtttccaattcacccccgagctggatatgcccttgccagcatcttatatgatctca

SEQ ID NO: 356 - DNA, 1341 bp, Pyrrosia stigmosa
atggctgtggatgtcgtcgctagcgactggaataaccggattagagatgccgtcataaagatctcatctaaaatcccagaagtcggtgctgctgttagcattctcatcgggttcttctggccacagaacaaggtcgacgtttttcaggccctcaaggcggacctgacaaagcttgtcaagaaggagattcttgactatgaactgaacctacatcaatctgagatcaatgcactaaaaaaaatcatggagagatacaaggcggcacagactcacgagaagggtaattttctaagcaactggatcacagaggctgacgaattgagtatcatctttcgagagtcgaccaacaatatccacctcatccttcccatcatcacccttgctctgcttcatctcataggactgcgagagaggcttgactttggcaaggagctctatcaggaggacaatacactacagtggaaggaggatcttgaggagatgtataagacatacattctggattttcttccagatatctttagaaagtggaaattgtggagggcaaatcaggtggagatcaaaggatggacagaaccgcacccaacagcaattccccctttctttcggatcgaatctcatgcaacggtcgtggatacggttacaggtgagaggaagcatttctctgtagatttgacagactcaacgagtgtgtttgcaagaatttgcgaagatcagaagactcggatgtgcaatgatgccactgcggacatggccggctgcatatctccctcgtttgtttttcacaagctactgcctgacaacaacaagaatctccccaagtatgacaaggaggtgtttggtcgaatgttcaagggcccttattccggagatctttgcatgagcgagctaaattttggatttggcaacccgattcgagctttccgaagtcgtccagatcacgatgattacacacctgatttgggtccaatcgttaagttgatcataagagagtggaactctattgatgccatgcaattcgtgtatgaaaaccatcaaggaaagctggctggtaatgagggtgggggacagaggcacgagattgatgtgacaggcaaggccataaatggattgcgcatgggcttctcgaatggggtgctgacctacgtccaggtcagttataacgagggtacagcatcagctacgtatgggaaccgcagtggttggcgatgtgaggaagtaaatgcgaaaggccccgctgcctacagggtcagctcgtggagctatagggcagattggggcccttcaaactcatatggccccagcgtagtcctattggaatatgcgccgcagcacatggaa

SEQ ID NO: 357 - DNA, 1341 bp, Pyrrosia stigmosa
atggctgtggatgtcgtcgctagcgactggaataaccggattagagatgccgtcataaagatctcatctaaaatcccagaagtcggtgctgctgttagcattctcatcgggttcttctggccacagaacaaggtcgacgtttttcaggccctcaaggcggacctgacaaagcttgtcaagaaggagattcttgactatgaactgaacctacatcaatctgagatcaatgcactaaaaaaaatcatggagagatacaaggcggcacagactcacgagaagggtaattttctaagcaactggatcacagaggctgacgaattgagtatcatctttcgagagtcgaccaacaatatccacctcatccttcccatcatcacccttgctctgcttcatctcataggactgcgagagaggcttgactttggcaaggagctctatcaggaggacaatacactacagtggaaggaggatcttgaggagatgtataagacatacattctggattttcttccagatatctttagaaagtggaaattgtggagggcaaatcaggtggagatcaaaggatggacagaaccgcacccaacagcaattccccctttctttcggatcgaatctcatgcaacggtcgtggatatggttacaggtgagaggaagcatttctctgtagatttgacagactcaacgagtgtgtttgcaagaatttgcgaagatcagaagactcggatgtgcaatgatgccactgcggacatggccggctgcatatctccctcgtttgtttttcacaagctactgcctgacaacaacaagaatctccccaagtatgacaaggaggtgtttggtcgaatgttcaagggcccttattccggagatctttgcatgagcgagctaaattttggatttggcaacccgattcgagctttccgaagtcgtccagatcacgatgattacacacctgatttgggtccaatcgttaagttgatcataagagagtggaactctattgatgccatgcaattcgtgtatgaaaaccatcaaggaaagctggctggtaatgagggtgggggacagaggcacgagattgatgtgacaggcaaggccataaatggattgcgcatgggcttctcgaatggggtgctgacctacgtccaggtcagttataacgagggtacagcatcagctacgtatgggaaccgcagtggttggcgatgtgaggaagtaaatgcgaaaggccccgctgcctacagggtcagctcgtggagctatagggcagattggggcccttcaaactcatatggccccagcgtagtcctattggaatatgcgccgcagcacatggaa

SEQ ID NO: 358 - DNA, 1509 bp, Polypodium attenuatum
atggaggaggaggttggtccccttcatggggaggaagggcgtggagagtcatccagcccaactgatgaggtggggagcctggacgatgctaatataggtcaggagcttccccaaaacatgcaagtggaggcccatgactggcataatcggatgagagctgctatgctggcgctgatatccgcaatcccgaaggtgggtgctgtcgtaagctcaatcatcggcatcttctggccagcaaacatgcaggacatttgggtggccctcaacatggaggagtatgtcaaaaacatcgtgaagcaggagatttttgaattcgagatgaggcagcttcagtcctccatccaggcgctggaaaccagtatccggagatatgaaagggctgcgctgcttgaaaaggggtctttcctaagcatctggatctcgcaagctgacaagctgtactttcagttgcgcaattctgccaacgacatccaccttctccttcacgttgtcaccgtgtctgtgcttcatatggtcgccatgcatgagcgactgacatttggcgaggaactctacggctcagacaattcagaaaaatggacgaaagacattgtggaggtgtttcagatgtacacatctgatttcattccaagcctgttcaagaagtggaagcagtggagggaggaacagattgagattagagcctgggtcgtaccgggtgtatggggaaatgtgtctcaaattacaccagacgtttctcatgctacagtggaggataagcttacaggggaaagtttcaggtttcaggcaacacgacggaactcaacaacgattttcttagatgtgtgccaagaccacaaatccaggatggtgaatgaggccgttgcggacatggccagctgcttgtcatctacttttgcttttcgcagcctcctgccagaccgcattcaggagcaatacccggcttatgatagagagctgttcggccaagttttcagaggcccatattcgcaggatctttgtaggcgggtcatcaatgaattcagaacctttagaacgcggccaactagctctgatcaaacggctctagacagagtctgggaggtgattgtagtaacggcgaacttcctgaataccatacaattcgtctacttcgacgataatgccaggattccaggggttgtggccggaaaccctaataccgcagggcgcgttttcgtacaccgtatcgatgtgttggataggcccatacgcgatctgcgactggagttctctagcgaagcccttgccacgttgcagctttatttcgaagatggttcatcaacgcaaaggatgggcgccactttcatgacttccgttgaggagagagtgacctgtacagtccctcgcggctacaggctcagctcatgggccttccgcgaggatcccgccattagtgtgctccgcttccaattcacccccgaagagctccgtcccatccccgcccagatgatcatgatcccccccacccggccgcaacccacaccaccc

SEQ ID NO: 359 - DNA, 1509 bp, Polypodium attenuatum
atggaggaggaggttggtccccttcatggggaggaagggcgtggagagtcatccagcccaactgatgaggtggggagcctggacgatgctaatataggtcaggagcttccccaaaacatgcaagtggaggcccatgactggcataatcggatgagagctgctatgctggcgctgatatccgcaatcccgaaggtgggtgctgtcgtaagctcaatcatcggcatcttctggccagcaaacatgcaggacatttgggtggccctcaacatggaggagtatgtcaaaaacatcgtgaagcaggagatttttgaattcgagatgaggcagcttcagtcctccatccaggcgctggaaaccagtatccggagatatgaaagggctgcgctgcttgaaaaggggtctttcctaagcatctggatctcgcaagctgacaagctgtactttcagttgcgcaattctgccaacgacatccaccttctccttcacgttgtcaccgtgtctgtgcttcatatggccgccatgcatgagcgactgacatttggcgaggaactctacggctcagacaattcagaaaaatggacgaaagacattgtggaggtgtttcagatgtacacatctgatttcattccaagcctgttcaagaagtggaagcagtggagggaggaacagattgagattagagcctgggtcgtaccgggtgtatggggaaatgtgtctcaaattacaccagacgtttctcatgctacagtggaggataagcttacaggggaaagtttcaggtttcaggcaacacgacggaactcaacaacgattttcttagatgtgtgccaagaccacaaatccaggatggtgaatgaggccgttgcggacatggccagctgcttgtcatctacttttgcttttcgcagcctcctgccagaccgcattcaggagcaatacccggcttatgatagagagctgttcggccaagttttcagaggcccatattcgcaggatctttgtaggcgggtcatcaatgaattcagaacctttagaacgcggccaactagctctgatcaaacggctctagacagagtctgggaggtgattgtagtaacggcgaacttcctgaataccatacaattcgtctacttcgacgataatgccaggattccaggggttgtggccggaaaccctaataccgcagggcgcgttttcgtacaccgtatcgatgtgttggataggcccatacgcgatctgcgactggagttctctagcgaagcccttgccacgttgcagctttatttcgaagatggttcatcaacgcaaaggatgggcgccactttcatgacttccgttgaggagagagtgacctgtacagtccctcgcggctacaggctcagctcatgggccttccgcgaggatcccgccattagtgtgctccgcttccaattcacccccgaagagctccgtcccatccccgcccagatgatcatgatcccccccacccggccgcaacccacaccaccc

SEQ ID NO: 360 - DNA, 1509 bp, Polypodium attenuatum
atggaggaggaggttggtccccttcatggggaggaagggcgtggagagtcatccagcccaactgatgaggtggggagcctggacgatgctaatataggtcaggagcttccccaaaacatgcaagtggaggcccatgactggcataatcggatgagagctgctatgctggcgctgatatccgcaatcccgaaggtgggtgctgtcgtaagctcaatcatcggcatcttctggccagcaaacatgcaggacatttgggtggccctcaacatggaggagtatgtcaaaaacatcgtgaagcaggagatttttgaattcgagatgaggcagcttcagtcctccatccaggcgctggaaaccagtatccggagatatgaaagggctgcgctgcttgaaaaggggtctttcctaagcatctggatctcgcaagctgacaagctgtactttcagttgcgcaattctgccaacgacatccaccttctccttcacgttgtcaccgtgtctgtgcttcatatggccgccatgcatgagcgactgacatttggcgaggaactctacggctcagacaattcagaaaaatggacgaaagacattgtggaggtgtttcagatgtacacatctgatttcattccaagcctgttcaagaagtggaagcagtggagggaggaacagattgagattagagcctgggtcgtaccgggtgtatggggaaatgtgtctcaaattacaccagacgtttctcatgctacagtggaggataagcttacaggggaaagtttcaggtttcaggcaacacgacggaactcaacaacgattttcttagatgtgtgccaagaccacaaatccaggatggtgaatgaggccgttgcggacatgaccagctgcttgtcatctacttttgcttttcgcagcctcctgccagaccgcattcaggagcaatacccggcttatgatagagagctgttcggccaagttttcagaggcccatattcgcaggatctttgtaggcgggtcatcaatgaattcagaacctttagaacgcggccaactagctctgatcaaacggctctagacagagtctgggaggtgattgtagtaacggcgaacttcctgaataccatacaattcgtctacttcgacgataatgccaggattccaggggttgtggccggaaaccctaataccgcagggcgcgttttcgtacaccgtatcgatgtgttggataggcccatacgcgatctgcgactggagttctctagcgaagcccttgccacgttgcagctttatttcgaagatggttcatcaacgcaaaggatgggcgccactttcatgacttccgttgaggagagagtgacctgtacagtccctcgcggctacaggctcagctcatgggccttccgcgaggatcccgccattagtgtgctccgcttccaattcacccccgaagagctccgtcccatccccgcccagatgatcatgatcccccccacccggccgcaacccacaccaccc

SEQ ID NO: 361 - DNA, 1341 bp, Aglaomorpha
atggctgcgggtgtcgtcgctagtgactggaataaccggatcagagatgccgtcataaagatctcatctaaagtcccggaagtgggtactgttgtgagcgttctcattgggttcttctggccacagaacaaggtcgatgtttttcaggccctcaaggcagacttaacaaagcttgtaaagaaagagattctcgactatgaactgaacctacatcaatcggagattaatgcactaaaaattgtcatggggagataccaggcggcacggactcacgaaaagggttattttctaagcaactggatcacggaggctgacagattgagtgtcatatttcgagagtcaaccaacaacatccaactcatccttcccatcatcaccctggctctgcttcatctcataggactgcgggagagactcgactttggcaaggagctctaccaggaggacaacacacaacagtggaaggaggatcttgaggagatgtataaggcatacattgtggattctcttccagatatcttcagaaagtggaaattgtggagggcaaatcaggtggagattaaagcctggacagaaacgcacccaacagcaattccccctttctttaggatggagtctcatgcaacagttgtggatttgatcacaggtgagaggaagcatttttctgtagacttgacagagtcaaagagcatatttgcaagaatctgcgaagatcagaagactcgtatgtgcaatgatgccactgcggacatgtccggctgcatatccccctcgtttgtattccacaagctattacctgacaactacaagaatttccccaaatatgacaaggaggtgtttggtcgaatgttcagaggtccttattccgcagatctttgcaggagcgatctaaattttggatttggctacccaattccaatttttcgaacccgtccggatcatgatgactatgcacccgattcaggtccaatcactaagttgatcttaagagagtggaattctattgatgccatgcaatttatctatgcaaaccgtcgaggaaatctggccggtgatgagcgtgggggacagaggcatgagattgatgtgatgggcaaggccataaatggatttcacatgggcttctctaatggagtgctcacacatgtacaagtcatctataatgatggcacatcatcatctacatatgggaaccgcagtggttggcgatgtgaggaagtatatgcaaaaggcccatctgcctacagggtcagttcttggagctatagggtagatatgggcccttcagaatcatatggccccagtgtagtccaattggaatatgtgccgcagcagttggaa

SEQ ID NO: 362 - DNA, 1341 bp, Aglaomorpha
atggctgcgggtgtcgtcgctagcgactggaataaccggatcagagatgctgtcataaagatctcatctaaagtcccggaagtgggtactgttgtgagcattcttgtcgggttcttctggccacagaacaagatcgacatttttcaggccctcaaggcagacttgacaaagcttgtcaagaaagagattcttgactatgaactgaacctacatcaatctgagattaatgcactaaaaattgtcatggggagataccaggcggcacggactcatgagaagggtaactttctaagcaactggatcacggaggctgacagattgagtgtcatctttcgagagtcgaccaacaatatccacctcatccttccggtcatcaccctggctctgcttcatctcataggactgcgggagagactcgactttggcaaggagctctatcaggaggacaatacacaacagtggaaggaggaccttgaggaaatatataagacatacattgtggattttcttccagatatcttcagaaagtggaaattgtggagggcaaatcaggtggagattaaagcctggacggaaacgcacccaacagcgatcccccctttctttcggatcgagtctcatgcaacagtcgtggatacgattacaggtgagaggaagcatttctctgtagatttgacagagtcaaagagcatattcgcaagaatctgcgaagatcagaagactcggatgtgcaatgatgccgctgcggacatggccggctgcatatccccctcatttgtttttcacaagctattacctgacaataacaagaatttccctaagtatgacaaggaggtgtttggtcggatgttcagaggtccttattccgcggatctttgcaagagcgatctaaattttgggtttggcaacaccattccaatttttcgaactcggccggatcatgatgactatgccccagaatcaggtccaatcacgaagttgatcataagagagtggaactctattgatgccatgcaatttatgtatgcaaaccgtcaaggaaatctggctggcgatgagcgggggggacagaggcacgagattgatgtgacaggcaaggccataaatggacttcgcatgggcttctctaatggagtgctcacatatgtccaagtccattataatgatggtacagcatcatctacatatgggaaccgcagtggttggcgatgtgaggaagtaaatccaaaaggcccatctgcctacagggtcagttcatggagctatagggtagatatgggcccttcagaatcatatggccccagtgtagtccagctggaatatgtgccgcagcagttggaa

SEQ ID NO: 363 - DNA, 1341 bp, Aglaomorpha
atggctgcgggtgtcgtcgctagcgactggaataaccggatcagagatgctgtcataaagatctcatctaaagtcccggaagtgggtactgttgtgagcattcttgtcgggttcttctggccacagaacaagatcgacatttttcaggccctcaaggcagacttgacaaagcttgtcaagaaagagattcttgactatgaactgaacctacatcaatctgagattaatgcactaaaaattgtcatggggagataccaggcggcacggactcatgagaagggtaactttctaagcaactggatcacggaggctgacagattgagtgtcatctttcgagagtcgaccaacaatatccacctcatccttccggtcatcatcctggctctgcttcatctcataggactgcgggagagactcgactttggcaaggagctctatcaggaggacaatacacaacagtggaaggaggaccttgaggaaatatataagacatacattgtggattttcttccagatatcttcagaaagtggaaattgtggagggcaaatcaggtggagattaaagcctggacggaaacgcacccaacagcgatcccccctttctttcggatcgagtctcatgcaacagtcgtggatacgattacaggtgagaggaagcatttctctgtagatttgacagagtcaaagagcatattcgcaagaatctgcgaagatcagaagactcggatgtgcaatgatgccgctgcggacatggccggctgcatatccccctcatttgtttttcacaagctattacctgacaataacaagaatttccctaagtatgacaaggaggtgtttggtcggatgttcagaggtccttattccgcggatctttgcaagagcgatctaaattttgggtttggcaacaccattccaatttttcgaactcggccggatcatgatgactatgccccagaatcgggtccaatcacgaagttgatcataagagagtggaactctattgatgccatgcaatttatgtatgcaaaccgtcaaggaaatctggctggcgatgagcgggggggacagaggcacgagattgatgtgacaggcaaggccataaatggacttcgcatgggcttctctaatggagtgctcacatatgtccaagtccattataatgatggtacagcatcatctacatatgggaaccgcagtggttggcgatgtgaggaagtaaatccaaaaggcccatctgcctacagggtcagttcatggagctatagggtagatatgggcccttcagaatcatatggccccagtgtagtccagctggaatatgtgccgcagcagttggaa

SEQ ID NO: 364 - DNA, 1341 bp, Aglaomorpha
atggctgcgggtgtcgtcgctagcgactggaataaccggatcagagatgctgtcataaagatctcatctaaagtcccggaagtgggtactgttgtgagcattcttgtcgggttcttctggccacagaacaaggtcgatgtttttcaggccctcaaggcagacttaacaaagcttgtaaagaaagagattctcgactatgaactgaacctacatcaatcggagattaatgcactaaaaattgtcatggggagataccaggcggcacggactcatgagaagggtaactttctaagcaactggatcacggaggctgacagattgagtgtcatctttcgagagtcgaccaacaatatccacctcatccttccggtcatcaccctggctctgcttcatctcataggactgcgggagagactcgactttggcaaggagctctatcaggaggacaatacacaacagtggaaggaggaccttgaggaaatatataagacatacattgtggattttcttccagatatcttcagaaagtggaaattgtggagggcaaatcaggtggagattaaagcctggacggaaacgcacccaacagcgatcccccctttctttcggatcgagtctcatgcaacagtcgtggatacgattacaggtgagaggaagcatttctctgtagatttgacagagtcaaagagcatattcgcaagaatctgcgaagatcagaagactcggatgtgcaatgatgccgctgcggacatggccggctgcatatccccctcatttgtttttcacaagctattacctgacaataacaagaatttccctaagtatgacaaggaggtgtttggtcggatgttcagaggtccttattccgcggatctttgcaagagcgatctaaattttgggtttggcaacaccattccaatttttcgaactcggccggatcatgatgactatgccccagaatcaggtccaatcacgaagttgatcataagagagtggaactctattgatgccatgcaatttatctatgcaaaccgtcgaggaaatctggccggtgatgagcgtgggggacagaggcatgagattgatgtgatggacaaggccataaatggatttcacatgggcttctctaatggagtgctcacacatgtacaagtcatctataatgatggcacatcatcatctacatatgggaaccgcagtggttggcgatgtgaggaagtatatgcaaaaggcccatctgcctacagggtcagttcttggagctatagggtagatatgggcccttcagaatcatatggccccagtgtagtccaattggaatatgtgccgcagcagttggaa

SEQ ID NO: 365 - DNA, 1341 bp, Aglaomorpha
atggctgcgggtgtcgtcgctagcgactggaataaccggatcagagatgctgtcataaagatctcatctaaagtcccggaagtgggtactgttgtgagcattcttgtcgggttcttctggccacagaacaagatcgacatttttcaggcccgcaaggcagacttgacaaagcttgtcaagaaagagattcttgactatgaactgaacctacatcaatctgagattaatgcactaaaaattgtcatggggagataccaggcggcacggactcatgagaagggtaactttctaagcaactggatcacggaggctgacagattgagtgtcatctttcgagagtcgaccaacaatatccacctcatccttccggtcatcaccctggctctgcttcatctcataggactgcgggagagactcgactttggcaaggagctctatcaggaggacaatacacaacagtggaaggaggaccttgaggaaatatataagacatacattgtggattttcttccagatatcttcagaaagtggaaattgtggagggcaaatcaggtggagattaaagcctggacggaaacgcacccaacagcgatcccccctttctttcggatcgagtctcatgcaacagtcgtggatacgattacaggtgagaggaagcatttctctgtagatttgacagagtcaaagagcatattcgcaagaatctgcgaagatcagaagactcggatgtgcaatgatgccgctgcggacatggccggctgcatatccccctcatttgtttttcacaagctattacctgacaataacaagaatttccctaagtatgacaaggaggtgtttggtcggatgttcagaggtccttattccgcggatctttgcaagagcgatctaaattttgggtttggcaacaccattccaatttttcgaactcggccggatcatgatgactatgccccagaatcaggtccaatcacgaagttgatcataagagagtggaactctattgatgccatgcaatttatgtatgcaaaccgtcaaggaaatctggctggcgatgagcgggggggacagaggcacgagattgatgtgacaggcaaggccataaatggacttcgcatgggcttctctaatggagtgctcacatatgtccaagtccattataatgatggtacagcatcatctacatatgggaaccgcagtggttggcgatgtgaggaagtaaatccaaaaggcccatctgcctacagggtcagttcatggagctatagggtagatatgggcccttcagaatcatatggccccagtgtagtccagctggaatatgtgccgcagcagttggaa

SEQ ID NO: 366 - DNA, 1371 bp, Aglaomorpha
atggctgcgggtgtcgtcgctagcgactggaataaccggatcagagatgctgtcataaagatctcatctaaagtcccggaagtgggtactgttgtgagcattcttgtcgggttcttctggccacagaacaagatcgacatttttcaggccctcaaggcagacttgacaaagcttgtcaagaaagagattcttgactatgaactgaacctacatcaatctgagattaatgcactaaaaattgtcatggggagataccaggcggcacggactcatgagaagggtaactttctaagcaactggatcacggaggctgacagattgagtgtcatctttcgagagtcgaccaacaatatccacctcatccttccggtcatcaccctggctctgcttcatctcataggactgcgggagagactcgactttggcaaggagctctatcaggaggacaatacacaacagtggaaggaggaccttgaggaaatatataagacatacattgtggattttcttccagatatcttcagaaagtggaaattgtggagggcaaatcaggtggagattaaagcctggacggaaacgcacccaacagcgatcccccctttctttcggatcgagtctcatgcaacagtcgtggatacgattacaggtgagaggaagcatttctctgtagatttgacagagtcaaagagcatattcgcaagaatctgcgaagatcagaagactcggatgtgcaatgatgccgctgcggacatggccggctgcatatccccctcatttgtttttcacaagctattacctgacaataacaagaatttccctaagtatgacaaggaggtgtttggtcggatgttcagaggtccttattccgcggatctttgcaagagcgatctaaattttgggtttggcaacaccattccaatttttcgaactcggccggatcatgatgactatgccccagaatcaggtccaatcacgaagttgatcataagagagtggaactctattgatgccatgcaatttatgtatgcaaaccgtcaaggaaatctggctggcgatgagcgggggggacagaggcacgagattgatgtgacaggcaaggccataaatggacttcgcatgggcttctctaatggagtgctcacatatgtccaagtccattataatgatggtacagcatcatctacatatgggaaccgcagtggttggcgatgtgaggaagtaaatccaaaaggcccatctgcctacagggtcagttcatggagctatagggtagatatgggcccttcagaatcatatggccccagtgtagtccagctggaatatgtgccgcagcagttggaattgtccatcttctggattggccaacttaat

SEQ ID NO: 367 - DNA, 1518 bp, Tectaria milnei
atggcagctaaggacgttaatacggtttctgagcttgctcccgctgctgaggaggtgcagaacgcagacatggccgaggaggacccaattttctcgcaattagcgcagaagatggttgctgctgcggagggggaggaggtccccgtagatcttcttgccagacacttgcaagtggaggctcatgactggcataaccggatcagaggcgccatactggggctgatatcctcagtgtcgatggtgggtgctggcgtaagcatgctcatcggcctcttttggccagaacgcaaggtggacatttgggaggccctcaatttggaggaatatatcaagaacattgtccagcagcagctgtttgaattcgagatgcggctccttcgggacgacatcgaagcgctgcagaccactgttgtgagatacgatagggctgcacttactgagaaggggaattttctaagcatctggatctcgcaagctgatgcattgtatattcggatgcgaaactctaccaacaacatccaccttccccttcacatggtcaccgtgtctacacttcatctcgcagccctgcatgagcgactgacatttggcgaggaactctatggcacaaaccattcagcgaattggacgcaagatcttgtggataagtttgagatgtacacaaccgatttgttcccgaatgttttcaaaaggtggaaggactggaggccaacccagatcgagattacagcatgggcacgcaatatgaattgcggcgttgttacctgtagacctgcaatgtcttatgctacagtggaggataagatctccggggcaatattctcgtttcaggtagcgaatcaaaactcaacaacaattttcgcaggagtttgccaagatcacaaaactcggatggtgaacgaggccattgctgacatggcgagctgcctgtcccccacttttgcttttcacaagctcctacccgttgatatgcagacgcggttctctgcttacgatagggagcagttcggacaggttttcagaggcccatattcccaagatctttcgcacggattctggacgactaacaaatccttcagatcgcacacaactcgctctgatattcagacaactcgcgatagaatcttggaggtgatcataagagcggaggcccatgttgatgcgatacagttcatatacgatcatgcggatccgaatgctacgactccagggattatggctggaaaccccacgggatcgatcaggtatctggttgatgtgagggatcgccccatacaggaaatgcgcatggagttcacttacgagattctttcttcgttgcaacttcatttcgaggatggtacagcacagaaattcggcaatgtaaatggttgggcgtctaggatactaacttgtacagccccctatggctacaggttcagctcctgggcctttcgcgaagatcccggcccctggaatacacccgccatcagtgtactccgcttccagttcacccccgagctggattttcccttgtct

SEQ ID NO: 368 - DNA, 1518 bp, Tectaria milnei
atggcagctaaggacgttaatacggtttctgagcttgctcccgctgctgaggaggtgcagaacgcagacatggccgaggaggacccaattttctcgcaattagcgcagaagatggttgctgctgcggagggggaggaggtccccgtagatcttcttgccagacacttgcaagtggaggctcatgactggcataaccggatcagaggcgccatactggggctgatatcctcagtgtcgatggtgggtgctggcgtaagcatgctcatcggcctcttttggccatcaaacaaggtggacatttgggaggccctcaatttcgaggaatatatcaagaacattgtccagcagcagctgtttgaattcgaaatgcggctcctttgggatgaaattgaagcgctggaaaccactgttgtgagatacaatagggctgcacttactgagaaggggaattttctaagcatctggatctcgcaagctgatgcattgtatattcggatgcgaaactctaccaacaacatccaccttctccttcacatggtcaccgtgtctacacttcatctcgcagccctgcatgagcgactgacatttggcgaggaactctatggcacaaaccattcagcgaattggacgcaagatcttgtggataagtttgagatgtacacaaccgatttgttcccgaatgttttcaaaaggtggaaggactggaggccaacccagatcgagattacagcatgggcacgcaatatgaattgcggcgttgttacctgtagacctgcaatgtcttatgctacagtggaggataaggtctccggggcaatattctcgtttcaggtagcgaatcaaaactcaacaacaattttcgcaggagtttgccaagatcacaaaactcggatggtgaacgaggccattgctgacatggcgagctgcctgtcccccacttttgcttttcacaagctcctacccgttgatatgcagacgcggttctctgcttacgatagggagcagttcggacaggttttcagaggcacatattcccaagatctttcgcacggattctggacgactaacaaatccttcagatcgcacacaactcgctctgatattcagacaactcgcgatagaatcttggaggtgatcataagagcggaggcccatgttgatgcgatacagttcatatacgatcatgcggatccgaatgctacgactccagggattatggctggaaaccccacgggatcgatcaggtatctggttgatgtgagggatcgccccatacaggaaatgcgcatggagttcacttacgagattctttcttcgttgcaacttcatttcgaggatggtacagcacagaaattcggcaatgtaaatggttgggcgtctaggatactaacttgtacagccccctatggctacaggttcagctcctgggcctttcgcgaagatcccggcccctggaatacacccgccatcagtgtactccgcttccagttcacccccgagctggattttcccttgtct

SEQ ID NO: 369 - DNA, 1518 bp, Tectaria milnei
atggcagctaaggacgttaatacggtttctgagcttgctcccgctgctgaggaggtgcagaacgcagacatggccgaggaggacccaattttctcgcaattagcgcagaagatggttgctgctgcggagggggaggaggtccccgtagatcttcttgccagacacttgcaagtggaggctcatgactggcataaccggatcagaggcgccatactggggctgatatcctcagtgtcgatggtgggtgctggcgtaagcatgctcatcggcctcttttggccatcaaacaaggtggacatttgggaggccctcaatttcgaggaatatatcaagaacattgtccagcagcagctgtttgaattcgaaatgcggctcctttgggatgaaattgaagcgctggaaaccactgttgtgagatacaatagggctgcacttactgagaaggggaattttctaagcatctggatctcgcaagctgatgcattgtatattcggatgcgaaactctaccaacaacatccaccttctccttcacatggtcaccgtgtctacacttcatctcgcagccctgcatgagcgactgacatttggcgaggaactctatggcacaaaccattcagcgaattggacgcaagatcttgtggataagtttgagatgtacacaaccgatttgttcccgaatgttttcaaaaggtggaaggactggaggccaacccagatcgagattacagcatgggcacgcaatatgaattgcggcgttgttacctgtagacctgcaatgtcttatgctacagtggaggataaggtctccggggcaatattctcgtttcaggtagcgaatcaaaactcaacaacaattttcgcaggagtttgccaagatcacaaaactcggatggtgaacgaggccattgctgacatggcgagctgcctgtcccccacttttgcttttcacaagctcctacccgttgatatgcagacgcggttctctgcttacgatagggagcagttcggacaggttttcagaggcccatattcccaagatctttcgcacggattctggacgactaacaaatccttcagatcgcacacaactcgctctgatattcagacaactcgcgatagaatcttggaggtgatcataagagcggaggcccatgttgatgcgatacagttcatatacgatcatgcggatccgaatgctacgactccagggattatggctggaaaccccacgggatcgatcaggtatctggttgatgtgagggatcgccccatacaggaaatgcgcatggagttcacttacgagattctttcttcgttgcaacttcatttcgaggatggtacagcacagaaattcggcaatgtaaatggttgggcgtctaggatactaacttgtacagccccctatggctacaggttcagctcctgggcctttcgcgaagatcccggcccctggaatacacccgccatcagtgtactccgcttccagttcacccccgagctggattttcccttgtct

SEQ ID NO: 370 - DNA, 1518 bp, Tectaria milnei
atggcagctaaggacgttaatacggtttctgagcttgctcccgctgctgaggaggtgcagaacgcagacatggccgaggaggacccaattttctcgcaattagcgcagaagatggttgctgctgcggagggggaggaggtccccgtagatcttcttgccagacacttgcaagtggaggctcatgactggcataaccggatcagaggcgccatactggggctgatatcctcagtgtcgatggtgggtgctggcgtaagcatgctcatcggcctcttttggccatcaaacaaggtggacatttgggaggccctcaatttcgaggaatatatcaagaacattgtccagcagcagctgtttgaattcgagatgcggctccttcgggacgacatcgaagcgctgcagaccactgttgtgagatacgatagggctgcacttactgagaaggggaattttctaagcatctggatctcgcaagctgatgcattgtatattcggatgcgaaactctaccaacaacatccaccttctccttcacatggtcaccgtgtctacacttcatctcgcagccctgcatgagcgactgacatttggcgaggaactctatggcacaaaccattcagcgaattggacgcaagatcttgtggataagtttgagatgtacacaaccgatttgttcccgaatgttttcaaaaggtggaaggactggaggccaacccagatcgagattacagcatgggcacgcaatatgaattgcggcgttgttacctgtagacctgcaatgtcttatgctacagtggaggataagatctccggggcaatattctcgtttcaggtagcgaatcaaaactcaacaacaattttcgcaggagtttgccaagatcacaaaactcggatggtgaacgaggccattgctgacatggcgagctgcctgtcccccacttttgcttttcacaagctcctacccgttgatatgcagacgcggttctctgcttacgatagggagcagttcggacaggttttcagaggcccatattcccaagatctttcgcacggattctggacgactaacaaatccttcagatcgcacacaactcgctctgatattcagacaactcgcgatagaatcttggaggtgatcataagagcggaggcccatgttgatgcgatacagttcatatacgatcatgcggatccgaatgctacgactccagggattatggctggaaaccccacgggatcgatcaggtatctggttgatgtgagggatcgccccatacaggaaatgcgcatggagttcacttacgagattctttcttcgttgcaacttcatttcgaggatggtacagcacagaaattcggcaatgtaaatggttgggcgtctaggatactaacttgtacagccccctatggctacaggttcagctcctgggcctttcgcgaagatcccggcccctggaatacacccgccatcagtgtactccgcttccagttcacccccgagctggattttcccttgtct

SEQ ID NO: 371 - DNA, 1338 bp, Doryopteris cordata
atgtcggtcgttgctagtgactggaacaaccggatccgggatgcggttatgaagctgtcatccaaaatcccgtatgtgggctctgccgcaagcattctcataggcctcttctggccacaaaacaaggtggacatttttgaggccctcaaggcagacctgataaagctcatcaggaaagagcttcttgactatgaactcaacctgcacaaatctgagatagatgcgctgaaagtaaccatggagagatatcaggcggcgcagacgcatgagaaggcttattttctcaacacatggatcagcgaggctgacaaattgagcgtcatctttcgacagtcggccaacaacatccatctcatcccacccgtcatcacgctggctctgcttcatctcacagggttgcgggaaaggctcgacttcggcaaggaactttatcaagaagacaatacgatccagtggaagcgggatctagaggagatgtataccacctacattgtgaacttcctccctgaaatcttcacaaagtggaaagcatggagagcagatcaggtagagatcaaagcatggaccgaaccacacccaacggcgattccacccttctttcgaatcgagtctcatgcgactgtggtggacactttgaacggtgaaagaaagcattactctgtggacttgaccgaatcgacgacaatcttctcaagagtttgcgaggcccacaagactcgcatgtgcaatgatgctgctagtgacatggctggttgcatatcaaccacgttcgtgtttgacaagctattacctgacaacatcaacaatttgcccaagtatgacaagggggtgttcgggcgtatgttcaaaggtccatactctcaagatctgttatcatcaggtggggattttggattgggtgccccagttccaaccttccgaataagtccaagtcagcatgactactcgcccagttcgggccctatcaccaaggtgattgtgagagagtggaacactatcgatgccttgcagtttgtatatgagaaccaggaggggatgcttgcaggaaatgcacgagggggcaaaagacacgacgtcgatgcaaggggaaagcccttacgtggactccgcatgggtttctcaaatggattgctaacctatgtccaaatcctttatgttgatgcagccactccatcatcaccaacattagggaaccgtcgtggctggcattgtcaggaagccattgcacatgcccccacttcctataagctcacttcttggagtttcaacgtcgacaatggcccttccgacacgttcggtccaagtgtcatccagctagaatatggtcctctactagat

SEQ ID NO: 372 - DNA, 1338 bp, Doryopteris cordata
atgtcggtcgttgctagtgactggaacaaccggatccgggatgcggttatgaagctgtcatccaaaatcccgtatgtgggctctgccgcaagcattctcataggcctcttctggccacaaaacaaggtggacatttttgaggccctcaaggcagacctgataaagctcatcaggaaagagcttcttgactatgaactcaacctgcacaaatctgagatagatgcgctgaaagtaaccatggagagatatcaggcggcgcagacgcatgagaaggcttattttctcaacacatggatcagcgaggctgacaaattgagcgtcatctttcgacagtcggccaacaacatccatctcatcccacccgtcatcacgctggctctgcttcatctcacagggttgcgggaaaggctcgacttcggcaaggaactttatcaagaagacaatacgatccagtggaagcgggatctagaggagatgtataccacctacattgtgaacttcctccctgaaatcttcacaaagtggaaagcatggagagcagatcaggtagagatcaaagcatggaccgaaccacacccaacggcgattccacccttctttcgaatcgagtctcatgcgactgtggtggacactttgaacggtgaaagaaagcattactctgtggacttgaccgaatcgacgacaatcttctcaagagtttgcgaggcccacaagactcgcatgtgcaatgatgctgctagtgacatggctggttgcatatcaaccacgttcgtgtttgacaagctattacctgacaacatcaacaatttgcccaagtatgacaagggggtgttcgggcgtatgttcaaaggtccatactctcaagatctgttatcatcaggtggggattttggattgggtgccccagttccaaccttccgaataagtccaagtcagcatgactactcgcccagttcgggccctatcaccaaggtgattgtgagagagtggaacactatcgatgccttgcagtttgtatatgagaaccaggaggggatgcttgcaggaaatgcacgagggggcaaaagacacgacgtcgatgcaaggggaaagcccttacgtggactccgcatgggtttctcaaatggattgctaacctatgtccaaatcctttatgttgatgcagccactccatcatcaccaacattagggaaccgtcgtggttggcattgtcaggaagccaatgcacatgcccccacttcctataagctcacttcttggagtttcaacgtcgacaatggcccttccgacacgttcggtccaagtgtcatccagctagaatatggtcctctactagat

SEQ ID NO: 373 - DNA, 1338 bp, Doryopteris cordata
atgtcggtcgttgctagtgactggaacaaccggatccgggatgcggttatgaagctgtcatccaaaatcccgtatgtgggctctgccgcaagcattctcataggcctcttctggccacaaaacaaggtggacatttttgaggccctcaaggcagacctgataaagctcatcaggaaagagcttcttgactatgaactcaacctgcacaaatctgagatagatgcgctgaaagtaaccatggagagatatcaggcggcgcagacgcatgagaaggcttattttctcaacacatggatcagcgaggctgacaaattgagcgtcatctttcgacagtcggccaacaacatccatctcatcccacccgtcatcacgctggctctgcttcatctcacagggttgcgggaaaggctcgacttcggcaaggaactttatcaagaagacaatacgatccagtggaagcgggatctagaggagatgtataccacctacattgtgaacttcctccctgaaatcttcacaaagtggaaagcatggagagcagatcaggtagagatcaaagcatggaccgaaccacacccaacggcgattccacccttctttcgaatcgagtctcatgcgactgtggtggacactttgaacggtgaaagaaagcattactctgtggacttgaccgaatcgacgacaatcttctcaagagtttgcgaggcccacaagactcgcatgtgcaatgatgctgctagtgacatggctggttgcatatcaaccacgttcgtgtttgacaagctattacctgacaacatcaacaatttgcccaagtatgacaagggggtgttcgggcgtatgttcaaaggtccatactctcaagatctgttatcatcaggtggggattttggattgggtgccccagttccaaccttccgaataagtccaagtcagcatgactactcgcccagttcgggccctatcaccaaggtgattgtgagagagtggaacactatcgatgccttgcagtttgtatatgagaaccaggaggggatgcttgcaggaaatgcacgagggagcaaaagacacgacgtcgatgcaaggggaaagcccttacgtggactccgcatgggtttctcaaatggattgctaacctatgtccaaatcctttatgttgatgcagccactccatcatcaccaacattagggaaccgtcgtggttggcattgtcaggaagccaatgcacatgcccccacttcctataagctcacttcttggagtttcaacgtcgacaatggcccttccgacacgttcggtccaagtgtcatccagctagaatatggtcctctactagat

SEQ ID NO: 374 - DNA, 1338 bp, Doryopteris cordata
atgtcggtcgttgctagtgactggaacaaccgcattcgggatgcggttatgaagctgtcatccaaaatcccgtatgtgggttccgccgcaagcactctcataggcatcttctggccacaaaacaaggtggacatttttgaggccctcaaggcagatctgataaagctcgtcaggaaagagattcttgactatgaactgaacctgcacaattccgagatagatgcgctgagaataaccatggagagatatcaggcggcgcagatgcatgagaaggcattctttctcaacacatggatcagcgaggctgacaaattgagcgtcatctttcgacagtcggccaacaacatccatctcatcccgcccgtcatcactctggctctgcttcatctcgcagggttgcgggaaaggctcgacttcggcagggaactttatcatgaagacaatacgatccagtggaagcgggatctagaggagatgtataccacctacattgtgaacttcctccctgatatcttcaccaaatggaaagcatggagagcagatcaggtagagatcaacgcatggaccgaaccacacccgacggcgattccgcccttctttcggatcgagtctcatgcaactgtagtggacactttgaccggtgaaagaaagcgttactctgtggatctgaccgaatcaacgacaattttctcaagtgtgtgcgatgcccacaagagtcgcatgtgcaatgatgctgctagtgacatggctggctgcatatcaaccacgttcgtgttttacaagctattacctgacaacctcaaacatttgcccaagtatgacaagaaggtgttcgggcgtatgttcaaaggtccatactctcaagatctattactgtcaggtgggaattttggatttggccacccagtttcagccttccgaatgcgtccaaatcagcatgactactcgcccagctcgggcgctatcaccaaggtggttgtgagagagtggaacactatcgatgcattgcaatttgtatatgagaacaaggaaggtatgcttgctggaaacgcacgaggggggcaaaaacacgacgtcgatgcaaggggaaagcccttacgtggactccgcatgggtttctcaaatggattgttaacctatgtccaaatcctttatcttgatgcagccactccatcatcaccaacatttgggaaccgtcgtggttggcaatgccaggaagccattgcacatgcccccactttctataagctcacttcctggagtttcaaagtcgacaatggcccttccaacacgtccggcccaagcgtcatccagctagaatatggtcctctactagat

SEQ ID NO: 375 - DNA, 1338 bp, Doryopteris cordata
atgtcggtcgttgctagtgactggaacaaccgcattcgggatgctgttatgaagctgtcatccaaaatcccgtatgtgggttccgccgcaagcactctcataggcattttctggccacaaaacaaggtggccatttttgaggccctcaaggcagatctgataaagctcgtcaggaaagagattcttgactatgaactgaacctgcacaattccgagatagatgcgctaagaataaccatggagagatatcaggcggcgcagacgcatgagaaggcattctttctcaacacatggatcagcgaggctgacaaactgagcgtcatctttcgacagtcggccaacaacatccatctcatcccacccgtcatcacgctggctctgcttcatctcacagggttgcgggaaaggctcgacttcggcaaggaactttaccatgaagacaatacgatccagtggaagcgggatcttgaggagatgtataccacctacattgtgaacttcctccctgatatcttcacaaaatggaaagcatggagagcagatcaggtagagatcaaagcatggaccgaaccacacccgacggcgattccgcccttctttcggatcgagtctcatgcaactgtagtggacactttgaccggtgaaagaaagcgttactctgtggatctgaccgaatcaacgacaattttctcaagtgtgtgcgatgcccacaagagtcgcatgtgcaatgatgctgctagtgacatggctggctgcatatcaaccacgttcgtgttttacaagctattatctgacaacctcaaacatttgcccaagtatgacaagaaggtgttcgggcgtatgttcaaaggtccatactctcaagatctattactgtcaggtgggaattttggatttggccacccagtttcagccttccgaatgcgtccaaatcagcatgactactcgcccagctcgggcgctatcaccaaggtgattgtgagagagtggaacactatcgatgcattgcaatttgtatatgagaacaaggaaggtatgcttgcaggaaacgcacggggggggcaaagacacgacgtcgatgcaaggggaaagcccttacgtggactccgcatgggtttctcaaatggattgttaacctatgtccaaatcctttatcttgatgcagccactccatcatcaccaacatttgggaaccgtcgtggttggcaatgtcaggaagccattgcacatgcccccactttctataagctcacttcctggagtttcaaagtcgacaatggcccttccaacacgtccggcccaagcgtcatccagctagaatatggtcctctactagat

SEQ ID NO: 376 - DNA, 1338 bp, Doryopteris cordata
atgtcggtcgttgctagtgactggaacaaccggatgcgggatgcggttatgaagctgtcatccaaaatcccatatgtgggttctgccgcaagcattctcataggcctcttctggccacaaaacaaggtggacatctttgaggccctcaaggcagatctgataaagctcatcaggaaagaggttcttgactatgaactgaacctacacaaatccgagatagatgcgctgaaaataaccattgagagatatcagacggcgcagatgcatgagaaggcttattttctcaacacatggatcagcgaggctgacaaattgagcgtcatctttcgacagtcgggcaacaacatccatctcatcccacccgtgatcactctggctctgcttcatctcatagggttgcgggaaaggctcgacttcggcaaggaactttatcatgaagacaatacgatccagtggaagcgggatctagaggagatgtataccacatacattgtggacttcctccctaatatcttcacgaaatggaaagcatggagagcagatcaggtggagatcaaagcatggaccgagccacacccgacggcgattccgcccttctttcggatcgagtctcatgcaactgtagtggacactttgacaggtgagagaaagcattactctgtggatctgaccgaatcgaggacaattttctcaagtgtctgcgaggcccacaagactcgcatgtgcaatgatgctgctagtgacatggctggctgcatatcaacctcgttcgtgtttgacaagctattacctgacaacatccacaaattgcccaagtatgacaagggggtgttcgggcgtatgttcaaaggtccatactctcaagatctattactgtcaggagggaactttggatttggctgcccagttccaatcttccgaatgagtccaaatcagcatgactactctcccagctcgggcgctatcaccaaggtgattgtgagagagtggaatactatcgatgccttgcagtttgtatatgagaacaaggaggggatgcttgcaggaaacgcacgaggggggcaaagacacgagatcgatgcaaggggaaaacccttacgtggactccgcatgggcttctcaaatggattgttaacctatgtccaaatcctttatcttgatgcatccactcaatcatcaccaacatttggaaaccgtcgtggttggcaatgtcacgaagccattgcacatgcccccacttcctataagctcacttcttggagtttcaaagttgacagtggcccttccaacacgctcggtccaagcgtcatccagttggaatatggtcctctactagat

SEQ ID NO: 377 - DNA, 1356 bp, Asplenium flabellifolium
atgacagcgccagcagctgatccgaaatcagcacaagagatgatcactgacgacgttaataatgtttctgtgcctgctgctgctggtgttgaggaggggcaggaggttaccgtagatctgctcgccaaaaacatgcaaatcgaggctcatgactggcataacaggattagagacgctatcctggggctggcgtccgcaatcccgaaggtgggtgctgccgtaagcctgcttatcagcatattttggccagcaaacaaggtggatatttgggaggccctcaatgtggagcagtacattcggaacattgtcaagcaggagatttttgagttcgaaatgcagctacatcggtccgacattgaggcgctgcaatccactatttcgcgatacgatacggctgcgcttagagagaaggggaatttcttaagcatctggatctcccaagctgaccaattgtctattcggttacgaaactccaccaacaacattcacctcctccttcacattgtcaccgtgtctgttcttcatgtcgcagccatgcacgagcgactcatgtttggcaaggaactctacggcgcagaccacacagcaagttggacgaaagatcttgtggacctgttcaatatgtacacagtcacttcaatcccaaggctcttcaacgagtggaagcagtggagagagagccagattgaggttaaggcatgggtggtaaggggcgcctggggcaatgttgtctctagaccagacgtttctcatgctacggtggaggataagctcacaggggagaaattcacgtttcgggcaaccagacgaaactcaacaacaattttctcaggagtttgttcagatcacaaaactcggatggggaacgaggccattgcggacatggccagctgcatgtcacccacgtttgggtttcatatgctcctacccggcgatgttcagacgcagctccctgcttatgataaggacctgtttggtcgggttttcaggggcccatattcccaggatcttttgcagcagctcttcacggatctcagagacttccgatcgcgtccgactcgcttcgaccagacggctcgcgacagaatcttgcaggtgatcataagagcgggtcaccatgttgatgctatacagtttttgtacgatcatttgaatccaaacatcatgactcaagggattatggctggaaactctgcgggggggaccaggcatcaggttgatgtgagggaccggcccatacacgaattgcgcatggagttctctcacaacgtgcttgcttcgttgcaacttcatttcgaagatggcacagcaacacggagatttggcaatcaacttaattgggcgtctcgtatagtc

SEQ ID NO: 378 - DNA, 1356 bp, Asplenium flabellifolium
atgacagcgccagcagctgatccgaaatcagcacaagagatgatcactgacgacgttaataatgtttctgtgcctgctgctgctggtgttgaggaggggcaggaggttaccgtagatctgctcgccaaaaacatgcaaatcgaggctcatgactggcataacaggattagagacgctatcctggggctggcgtccgcaatcccgaaggtgggtgctgccgtaagcctgcttatcagcatattttggccagcaaacaaggtggatatttgggaggccctcaatgtggagcagtacattcggaacattgtcaagcaggagatttttgagttcgaaatgcagctacatcggtccgacattgaggcgctgcaatccactatttcgcgatacgatacggctgcgcttagagagaaggggaatttcttaagcatctggatctcccaagctgaccaattgtctattcggttacgaaactccaccaacaacattcacctcctccttcacattgtcaccgtgtctgttcttcatgtcgcagccatgcacgagcgactcatgtttggcaaggaactctacggcgcagaccacacagcaagttggacgaaagatcttgtggacctgttcaatatgtacacagtcacttcaatcccaaggctcttcaacgagtggaagcagtggagagagagccagattgaggttaaggcatgggtggtaaggggcgcctggggcaatgttgtctctagaccagacgtttctcatgctacagtggaggataagctcacaggggagaaattcacgtttcgggcaaccagacgaaactcaacaacaattttctcaggagtttgttcagatcacaaaactcggatggggaacgaggccattgcggacatggccagctgcatgtcacccacgtttgggtttcatatgctcctacccggcgatgttcagacgcagctccctgcttatgataaggacctgtttggtcgggttttcaggggcccatattcccaggatcttttgcagcagctcttcacggatctcagagacttccgatcgcgtccgactcgcttcgaccagacggctcgcgacagaatcttgcaggtgatcataagagcgggtcaccatgttgatgctatacagtttttgtacgatcatttgaatccaaacatcatgactcaagggattatggctggaaactctgcgggggggaccaggcatcaggttgatgtgagggaccggcccacacacgaattgcgcatggagttctctcacaacgtgcttgcttcgttgcaacttcatttcgaagatggcacagcaacacggagatttggcaatcaacttaattgggcgtctcgtatagtc

SEQ ID NO: 379 - DNA, 1482 bp, Davallia pentaphylla
atggcaggatataatcacgtgcaggatcaattagtaatggcagctgatcaggacgttaatactgtttctgagcttgctcccgctactgataaggaagacatggccgtcgaagaggacccaatttttgcgcaattagcggagaagatggctgctgctgctgctgcagagaagggagaggcccctgtagatcttcttgcccaatacatgcaagtggaggctcatgactggcataaccggatcagaggcgccatactggggctgatatccttagtgccaaaggtgggtgctgctgtaagcaggctcatcggcctcttttggccagcaaacaaggtggacatttgggaggccctcaaggcggaggaatacatcaggaacattgtccagcaggagctttttgagttcgaaatgcggctccttcagaacgacatcgaagcgctggaaatgactgttgcgagatacgacagggctgcacttactgaaaaggggaactttctaagcatctggatcacgcaagctgatgcattgtatattcggatgcggaactctaccaacaacatccaccttctgcttcacatggtcactgtgtctacacttcatatggcagccctgcatgagcgactgacatttggcgaggaactgtatggcacaaacaattcagcgaattggacgcaagatcttgtggacaagttcgagaggtacacaaccgatttattcccgagtgttttcaaaaggtggaaggaatggaggccaacccagatcgagattagatcatggataaatagaggctcttgcggcaatcttacctgcagaccaaacgtttctcatgctacagtggaggacaagacctccggggcattcttctcatttcagtcaagcggtagtagctcaacaacaatgttcttagaagtttgcgaagaccacaaaactcggatggtgaacgaggccatcgcggacatggcgagctgcctgtcacccacttttgctttccacaagctcctacccgacgatattcaggcgcagttctctccttacgatcggcaggagttcggacaggtttttagaggcccatattcacaggatctttcgcacggagcctggacaaatttcaaaaacttcagatcgcgcacaacacgctctgatcagacacttcgcgatagaatcttggaggtgatcataagagcggggtctcatgttgatgctatgcagttcatgtacgatcatgtgaatccaagttttacgactccggggactatggctggaaacgccacgggaggaattaggcatccggttgatgtgagggatcggcccatacaggaattgcgcatggagtttgctcgagatgtgcttgcttccttgcagctccatttcgaggatggtacatcgacacagagattcggcaatgagctttttggtacttggccgactagaatactaacctgtacagcgccctatggctacagattcagctcatgggcctttcgt

SEQ ID NO: 380 - DNA, 1440 bp, Davallia pentaphylla
atggcaggatataatcacgtgcaggatcaattagtaatggcagctgatcaggacgttaatactgtttctgagcttgctcccgctactgataaggaagacatggccgtcgaagaggacccaatttttgcgcaattagcggagaagatggctgctgctgctgctgcagagaagggagaggcccctgtagatcttcttgcccaatacatgcaagtggaggctcatgactggcataaccggatcagaggcgccatactggggctgatatccttagtgccaaaggtgggtgctgctgtaagcaggctcatcggcctcttttggccagcaaacaaggtggacatttgggaggccctcaaggcggaggaatacatcaggaacattgtccagcaggagctttttgagttcgaaatgcggctccttcagaacgacatcgaagcgctggaaatgactgttgcgagatacgacagggctgcacttactgaaaaggggaactttctaagcatctggatcacgcaagctgatgcattgtatattcggatgcggaactctaccaacaacatccaccttctgcttcacatggtcactgtgtctacacttcatatggcagccctgcatgagcgactgacatttggcgaggaactgtatggcacaaacaattcagcgaattggacgcaagatcttgtggacaagttcgagaggtacacaaccgatttattcccgagtgttttcaaaaggtggaaggaatggaggccaacccagatcgagattagatcatggataaatagaggctcttgcggcaatcttacctgcagaccaaacgtttctcatgctacagtggaggacaagacctccggggcattcttctcatttcagtcaagcggtagtagctcaacaacaatgttcttagaagtttgcgaagaccacaaaactcggatggtgaacgaggccatcgcggacatggcgagctgcctgtcacccacttttgctttccacaagctcctacccgacgatattcaggcgcagttctctccttacgatcggcaggagttcggacaggtttttagaggcccatattcacaggatctttcgcacggagcctggacaaatttcaaaaacttcagatcgcgcacaacacgctctgatcagacacttcgcgatagaatcttggaggtgatcataagagcggggtctcatgttgatgctatgcagttcatgtacgatcatgtgaatccaagttttacgactccggggactatggctggaaacgccacgggaggaattaggcatccggttgatgtgagggatcggcccatacaggaattgcgcatggagtttgctcgagatgtgcttgcttccttgcagctccatttcgaggatggtacatcgacacagagattcggcaatgagctttttggtgatcataagagcggggtctcatgttga

SEQ ID NO: 381 - DNA, 1482 bp, Davallia pentaphylla
atggcaggatataatcacgtgcaggatcaattagtaatggcagctgatcaggacgttaatactgtttctgagcttgctcccgctactgataaggaagacatggccgtcgaagaggacccaatttttgcgcaattagcggagaagatggctgctgctgctgctgcagagaagggagaggcccctgtagatcttcttgcccaatacatgcaagtggaggctcatgactggcataaccggatcagaggcgccatactggggctgatatccttagtgccaaaggtgggtgctgctgtaagcaggctcatcggcctcttttggccagcaaacaaggtggacatttgggaggccctcaaggcggaggaatacatcaggaacattgtccagcaggagctttttgagttcgaaatgcggctccttcagaacgacatcgaagcgctggaaatgactgttgcgagatacgacagggctgcacttactgaaaaggggaactttctaagcatctggatcacgcaagctgatgcattgtatattcggatgcggaactctaccaacaacatccaccttctgcttcacatggtcactgtgtctacacttcatatggcagccctgcatgagcgactgacatttggcgaggaactgtatggcacaaacaattcagcgaattggacgcaagatcttgtggacaagttcgagaggtacacaaccgatttattcccgagtgttttcaaaaggtggaaggaatggaggccaacccagatcgagattagatcatggataaatagaggctcttgcggcaatcttacctgcagaccaaacgtttctcatgctacagtgaaggacaagacctccggggcattcttctcatttcagtcaagcggtagtagctcaacaacaatgttcttagaagtttgcgaagaccacaaaactcggatggtgaacgaggccatcgcggacatggcgagctgcctgtcacccacttttgctttccacaagctcctacccgacgatattcaggcgcagttctctccttacgatcggcaggagttcggacaggtttttagaggcccatattcacaggatctttcgcacggagcctggacaaatttcaaaaacttcagatcgcgcacaacacgctctgatcagacacttcgcgatagaatcttggaggtgatcataagagcggggtctcatgttgatgctatgcagttcatgtacgatcatgtgaatccaagttttacgactccggggactatggctggaaacgccacgggaggaattaggcatccggttgatgtgagggatcggcccatacaggaattgcgcatggagtttgctcgagatgtgcttgcttccttgcagctccatttcgaggatggtacatcgacacagagattcggcaatgagctttttggtacttggccgactagaatactaacctgtacagcgccctatggctacagattcagctcatgggcctttcgt

SEQ ID NO: 382 - DNA, 1521 bp, Microsorum commutatum
atggcagccttgcacatgaagaactcatcagaaatgatcggtggcgccgtcgctactcctactgacgttgttacttctggccgtgaaggcgctacagcagcagcagaggaatcactggataacgaggtggcgctggagggcggcaacgacgacatcgacgtgcttgccaataacatgcaattggaggctcatgactggcataaccgcacgagaggcgctgtgctggcgctgctatccgcaatcccgaaggttggtggtgccataagcaccctggtcggcctcttttggccggcgaacaaggtggacatttgggaggccctcaacatggaggcatatgttacgaacattgtccgaagggagattatggagttcgaaatgagacagctcgagggcgacattgaggcgctggaaaacaccattcagagatatgaaaggggttcgcttgctgagaaggcgattcacctaggcatctggatcgaacgagccgacgcactgtctattcggttggcaaactcctccaacaggattcatcttctcctccatattgtcaccgtggccgtgctccatatggccgcattgcatgagcggctgacatatggcgaggaactttacggcacaaacaattcagtgaattggacaaaagaactcgaacagcagttccacacgtacacgtccaatcgaatcccaacaatcttcaaggagtggagcccgtggagagaaagccagattgagatcacatcttccagaagacggcaacagatcggcgctgtcaattttaggccatccaattcttctgcgacagtggaggacaagatatcgggggagacaatcactttcagtatcgactacgagtactcgttgacgattttctcagatatttgtaatgctcacaaaacaaggatgatgaatcaggccaccgcagacatggccagttgcatgtcgcccacttttatttttcataagctcctacccaacgacattcaaagcaaagtctctccttatgataggcaggtattcgggcaagtttttcaagggccatattcacaggatcttctgcagcctcgcatcaccggtcgcaaggccttcacattgcacccaactcgtttcgatcaaacggcccgcactaaaatcttgcaggtgactgtaagagctgggtcccttcttgaagcgatacaattttggtatgatcatgcgactccaaatgccatgactccaggggtgatggccggaaatccgagaggagggactatatccaacgttgatgtgaagacacggcgcatacaggatttgcgcttggagttctctcgaaatgtgctagtttcgctgcagattcgattcgaagatggtacgtcaacacaaaagttcggcaatataactgggtggtatactagtacaaaaacttgtacagccccctctggctacaggcttagctcatgggcctttcgtgaagacacaggccccaacaatacaactgccatcagcgttgtccgcttccaattcacccccgatgaccccttgcca

SEQ ID NO: 383 - DNA, 1533 bp, Pyrrosia rupestris
atggcaggatataatcacgtgcaggatcaattagtaatggcagctgatcaggacgttaatactgtttctgagcttgctcccgctactgataaggtgcagaacgaagacatggtcgaagaggacccaatttttgcgcaattagcggagaagatggctgctgctgcagagaaaggggaggcccctgtagatcttcttgctcaatacatgcaagtggaggctcatgactggcataaccggatcagaggcgccatactggggctgatatccttagtgccaaaggtgggtgctgctgtaagcaggctcatcggcctcttttggccagcaaacaaggtggacatttgggaggccctcaaggcggaggaatatatcaggaacattgtccagcaggagctttttgagttcgaaatgcggctccttcaggacgacatcgaagcgctggaaatgactgttgcgagatacgatagggctgcacttactgaaaaggggaactttctaagcatctggatctcgcaagctgatgcattgtatattcggatgcggaactctaccaacaacatccaccttctccttcacatggtcactgtgtctacacttcatatggcagccctgcatgagcgactgacatttggcgaggaactgtatggcacaaacaattcagcgaattggacgcaagatcttgtggacaagttcgagaggtacacagccgatttaatcccgagtgttttcaaaaggtggaaggaatggaggccaacccagatcgagattagagcatggataaataggggctcatgcggcaatcttacttgtagaccaaacgtttctcatgctacagtggaggacaagacctccggggcaagattctcatttcagtcaagcggtagttcctcgacaacaatgttctcagaaatttgcgaagaccacaaaattcggatggtgaacgaggccatcgcggacatggcgagctgcctgtcacccacttttgctttccacaagctcctacccgacgatattcaggcgcagttctctccttacgatcggcaggagttcggacaggttttcagaggcccgtattcccaggatctttcgcacggagcttggacaaatttcaaaaacttcagatcgcgcacaacacgctctgatcagacacttcgcgatagaatcttggaggtgatcataagagcgggatctcatgttgatgctttacagttcatctacgatcatgtgaatccaaattctatgactccggggattatggctggaaatgccgcgggaggagttaggcatcaggttgatgtgagggatcggcccatacaggaagtgcgcatggagttcgctcgggatgtgcttgcttcgctgcagctccatttcgaggatggtacatcaacacagaaattcggcaatgaactttttggtacttgggcgactagaatactaacttgtacagcgccctatggctacagattcagctcatgggcctttcgtgaagatcccggcccctacagaacaaccgccatcagtgtactccgcttccaa

SEQ ID NO: 384 - DNA, 1533 bp, Pyrrosia rupestris
atggcaggatataatcacgtgcaggatcaattagtaatggcagctgatcaggacgttaatactgtttctgagcttgctcccgctactgataaggtgcagaacggtgacatggtcgaagaggacccaatttttgcgcaattagcggagaagatggctgctgctgcagagaaggaggaggcccccgtagatcttcttgcccaatacatgcaagtggaggctcatgactggcataaccggatcagaggcgccatactggggctgatatccgcagtgccgaaggtgggcgctgctataagcgggctcatcggcctgttttggccagcaaacaaggtggacatttgggaggctctaagggcggaggaatatatcaggaacattgtccagcaggagctttttgaattcgaaatgcggctccttcagaacgacatcgaagcgctggaaatgactgttgggagatacgatacggctgcacttactgaaaaggggaactttctaagcatctggatctcgcaagctgatgcattgtatattcggatgcggaactctaccaacaacatccaccttctccttcacatggtcactgtgtctacacttcatatggcagccctgcatgagcgactgacatttggcgaggagctgtatggcacaaacaattcagcgaattggacggcagatcttgtggacaagttcgagaggtacacaaccgacttaatcccgaatgttttcaaaaggtggaaggaatggaggccaacccagatcgagattacagcacgacgacggaggggctcatgcggcattgttacttgtagtccaaacgtttcttatgctacagtggaggacaagatctccggggcaacattctcgtttcaggcaacaaatcaatactcgttaacaattttctcagaagtatgtgaagaccacaaaactcggatggtgaacgaggccgttgcagacatggcgagctgcctgtcaccaacttttgcttttcacaagctcctacccgacaatattcaaggacagttttctccttacgatcggcaacaattcggacaggttttcagaggcccatattcccaggatctttcacacggactctggacggttttcaaaaacttcagatcgcgcacgacacgctctgatcagacacttcgcgatagaatcttgcaggtgatcataagagcggggtcccatgttgatgctttacaatttgtgtacgatcatgcgaatccaaattctacgactccggggactctggctggaaacgccacgggaggaattagacatcaggttaatgtgagggatccgcccatacaggaactgcgcatggagttcgctcgggatgtgcttgcttcgttgcagcttcatttcgcggatggtacatcaacacagaaattcggcaatgtaatttttggtacttgggcgactagaatactaacttgtacagcgccctatggctatagattcagctcatgggcctttcgtgaagatcccggcccctacagaacaaccgccatcagtgtactccgcttccaa

SEQ ID NO: 385 - DNA, 1533 bp, Pyrrosia rupestris
atggcaggatataatcacgtgcaggatcaattagtaatggcagctgatcaggacgttaatactgtttctgagcttgctcccgctactgataaggtgcagaacgaagacatggtcgaagaggacccaatttttgcgcaattagcggagaagatggctgctgctgcagagaaaggggaggcccctgtagatcttcttgctcaatacatgcaagtggaggctcatgactggcataaccggatcagaggcgccatactggggctgatatccttagtgccaaaggtgggtgctgctgtaagcaggctcatcggcctcttttggccagcaaacaaggtggacatttgggaggccctcaaggcggaggaatatatcaggaacattgtccagcaggagctttttgagttcgaaatgcggctccttcaggacgacatcgaagcgctggaaatgactgttgcgagatacgatagggctgcacttactgaaaaggggaactttctaagcatctggatctcgcaagctgatgcattgtatattcggatgcggaactctaccaacaacatccaccttctccttcacatggtcactgtgtctacacttcatatggcagccctgcatgagcgactgacatttggcgaggaactgtatggcacaaacaattcagcgaattggacgcaagatcttgtggacaagttcgagaggtacacagccgatttaatcccgagtgttttcaaaaggtggaaggaatggaggccaacccagatcgagattagagcatggataaataggggctcatgcggcaatcttacttgtagaccaaacgtttctcatgctacagtggaggacaagacctccggggcaagattctcatttcagtcaagcggtagttcctcgacaacaatgttctcagaaatttgcgaagaccacaaaattcggatggtgaacgaggccatcgcggacatggcgagctgcctgtcacccacttttgctttccacaagctcctacccgacgatattcaggcgcagttctctccttacgatcggcaacaattcggacaggttttcagaggcccatattcccaggatctttcacacggactctggacggttttcaaaaacttcagatcgcgcacgacacgctctgatcagacacttcgcgatagaatcttgcaggtgatcataagagcggggtcccatgttgatgctttacaatttgtgtacgatcatgcgaatccaaattctacgactccggggactctggctggaaacgccacgggaggaattagacatcaggttaatgtgagggatccgcccatacaggaactgcgcatggagttcgctcgggatgtgcttgcttcgttgcagcttcatttcgcggatggtacatcaacacagaaattcggcaatgtaatttttggtacttgggcgactagaatactaacttgtacagcgccctatggctatagattcagctcatgggcctttcgtgaagatcccggcccctacagaacaaccgccatcagtgtactccgcttccaa

SEQ ID NO: 386 - DNA, 1533 bp, Pyrrosia rupestris
atggcaggatataatcacgtgcaggatcaattagtaatggcagctgatcaggacgttaatactgtttctgagcttgctcccgctactgataaggtgcagaacggtgacatggtcgaagaggacccaatttttgcgcaattagcggagaagatggctgctgctgcagagaaggaggaggcccccgtagatcttcttgcccaatacatgcaagtggaggctcatgactggcataaccggatcagaggcgccatactggggctgatatccgcagtgccgaaggtgggcgctgctataagcgggctcatcggcctgttttggccagcaaacaaggtggacatttgggaggctctaagggcggaggaatatatcaggaacattgtccagcaggagctttttgaattcgaaatgcggctccttcagaacgacatcgaagcgctggaaatgactgttgggagatacgatacggctgcacttactgaaaaggggaactttctaagcatctggatctcgcaagctgatgcattgtatattcggatgcggaactctaccaacaacatccaccttctccttcacatgggcactgtgtctacacttcatatggcagccctgcatgagcgactgacatttggcgaggagctgtatggcacaaacaattcagcgaattggacggcagatcttgtggacaagttcgagaggtacacaaccgacttaatcccgaatgttttcaaaaggtggaaggaatggaggccaacccagatcgagattacagcacgacgacggaggggctcatgcggcattgttacttgtagtccaaacgtttcttatgctacagtggaggacaagatctccggggcaacattctcgtttcaggcaacaaatcaatactcgttaacaattttctcagaagtatgcgaagaccacaaaactcggatggtgaacgaggccgttgcagacatggcgagctgcctgtcaccaacttttgcttttcacaagctcctacccgacaatattcaaggacagttttctccttacgatcggcaacaattcggacaggttttcagaggcccatattcccaggatctttcacacggactctggacggttttcaaaaacttcagatcgcgcacgacacgctctgatcagacacttcgcgatagaatcttgcaggtgatcataagagcggggtcccatgttgatgctttacaatttgtgtacgatcatgcgaatccaaattctacgactccggggactctggctggaaacgccacgggaggaattagacatcaggttaatgtgagggatccgcccatacaggaactgcgcatggagttcgctcgggatgtgcttgcttcgttgcagcttcatttcgcggatggtacatcaacacagaaattcggcaatgtaatttttggtacttgggcgactagaatactaacttgtacagcgccctatggctacagattcagctcatgggcctttcgtgaagatcccggcccctacagaacaaccgccatcagtgtactccgcttccaa

SEQ ID NO: 387 - DNA, 1533 bp, Pyrrosia rupestris
atggcaggatataatcacgtgcaggatcaattagtaatggcagctgatcaggacgttaatactgtttctgagcttgctcccgctactgataaggtgcagaacggtgacatggtcgaagaggacccaatttttgcgcaattagcggagaagatggctgctgctgcagagaaggaggaggcccccgtagatcttcttgcccaatacatgcaagtggaggctcatgactggcataaccggatcagaggcgccatactggggctgatatccgcagtgccgaaggtgggcgctgctataagcgggctcatcggcctgttttggccagcaaacaaggtggacatttgggaggctctaagggcggaggaatatatcaggaacattgtccagcaggagctttttgaattcgaaatgcggctccttcagaacgacatcgaagcgctggaaatgactgttgggagatacgatacggctgcacttactgaaaaggggaactttctaagcatctggatctcgcaagctgatgcattgtatattcggatgcggaactctaccaacaacatccaccttctccttcacatggtcactgtgtctacacttcatatggcagccctgcatgagcgactgacatttggcgaggagctgtatggcacaaacaattcagcgaattggacgacagatcttgtggacaagttcgagaggtacacaaccgacttaatcccgaatgttttcaaaaggtggaaggaatggaggccaacccagatcgagattacagcacgacgacggaggggctcatgcggcattgttacttgtagtccaaacgtttcttatgctacagtggaggacaagatctccggggcaacattctcgtttcaggcaacaaatcaatactcgttaacaattttctcagaagtatgcgaagaccacaaaactcggatggtgaacgaggccgttgcagacatggcgagctgcctgtcaccaacttttgcttttcacaagctcctacccgacaatattcaaggacagttttctccttacgatcggcaacaattcggacaggttttcagaggcccatattcccaggatctttcacacggactctggacggttttcaaaaacttcagatcgcgcacgacacgctctgatcagacacttcgcgatagaatcttgcaggtgatcataagagcggggtcccatgttgatgctttacaatttgtgtacgatcatgcgaatccaaattctacgactccggggactctggctggaaacgccacgggaggaattagacatcaggttaatgtgagggatccgcccatacaggaactgcgcatggagttcgctcgggatgtgcttgcttcgttgcagcttcatttcgcggatggtacatcaacacagaaattcggcaatgtaatttttggtacttgggcgactagaatactaacttgtacagcgccctatggctatagattcagctcatgggcctttcgtgaagatcccggcccctacagaacaaccgccatcagtgtactccgcttccaa

SEQ ID NO: 388 - DNA, 1533 bp, Pyrrosia rupestris
atggcaggatataatcacgtgcaggatcaattagtaatggcagctgatcaggacgttaatactgtttctgagcttgctcccgctactgataaggtgcagaacggtgacatggtcgaagaggacccaatttttgcgcaattagcggagaagatggctgctgctgcagagaaggaggaggcccccgtagatcttcttgcccaatacatgcaagtggaggctcatgactggcataaccggatcagaggcgccatactggggctgatatccgcagtgccgaaggtgggcgctgctataagcgggctcatcggcctgttttgaccagcaaacaaggtggacatttgggaggctctaagggcggaggaatatatcaggaacattgtccagcaggagctttttgaattcgaaatgcggctccttcagaacgacatcgaagcgctggaaatgactgttgggagatacgatacggctgcacttactgaaaaggggaactttctaagcatctggatctcgcaagctgatgcattgtatattcggatgcggaactctaccaacaacatccaccttctccttcacatgggcactgtgtctacacttcatatggcagccctgcatgagcgactgacatttggcgaggagctgtatggcacaaacaattcagcgaattggacggcagatcttgtggacaagttcgagaggtacacaaccgacttaatcccgaatgttttcaaaaggtggaaggaatggaggccaacccagatcgagattacagcacgacgacggaggggctcatgcggcattgttacttgtagtccaaacgtttcttatgctacagtggaggacaagatctccggggcaacattctcgtttcaggcaacaaatcaatactcgttaacaattttctcagaagtatgcgaagaccacaaaactcggatggtgaacgaggccgttgcagacatggcgagctgcctgtcaccaacttttgcttttcacaagctcctacccgacaatattcaaggacagttttctccttacgatcggcaacaattcggacaggttttcagaggcccatattcccaggatctttcacacggactctggacggttttcaaaaacttcagatcgcgcacgacacgctctgatcagacacttcgcgatagaatcttgcaggtgatcataagagcggggtcccatgttgatgctttacaatttgtgtacgatcatgcgaatccaaattctacgactccggggactctggctggaaacgccacgggaggaattagacatcaggttaatgtgagggatccgcccatacaggaactgcgcatggagttcgctcgggatgtgcttgcttcgttgcagcttcatttcgcggatggtacatcaacacagaaattcggcaatgtaatttttggtacttgggcgactagaatactaacttgtacagcgccctatggctatagattcagctcatgggcctttcgtgaagatcccggcccctacagaacaaccgccatcagtgtactccgcttccaa

SEQ ID NO: 389 - DNA, 1578 bp, Pyrrosia rupestris
atggcaggatataatcacgtgcaggatcaattagtaatggcagctgatcaggacgttaatactgtttctgagcttgctcccgctactgataaggtgcagaacggtgacatggtcgaagaggacccaatttttgcgcaattagcggagaagatggctgctgctgcagagaaggaggaggcccccgtagatcttcttgcccaatacatgcaagtggaggctcatgactggcataaccggatcagaggcgccatactggggctgatatccgcagtgccgaaggtgggcgctgctataagcgggctcatcggcctgttttggccagcaaacaaggtggacatttgggaggctctaagggcggaggaatatatcaggaacattgtccagcaggagctttttgaattcgaaatgcggctccttcagaacgacatcgaagcgctggaaatgactgttgggagatatgatacggctgcacttactgaaaaggggaactttctaagcatctggatctcgcaagctgatgcattgtatattcggatgcggaactctaccaacaacatccaccttctccttcacatggtcactgtgtctacacttcatatggcagccctgcatgagcgactgacatttggcgaggagctgtatggcacaaacaattcagcgaattggacggcagatcttgtggacaagttcgagaggtacacaaccgacttaatcccgaatgttttcaaaaggtggaaggaatggaggccaacccagatcgagattacagcacgacgacggaggggctcatgcggcattgttacttgtagtccaaacgtttcttatgctacagtggaggacaagatctccggggcaacattctcgtttcaggcaacaaatcaatactcgttaacaattttctcagaagtatgcgaagaccacaaaactcggatggtgaacgaggccgttgcagacatggcgagctgcctgtcaccaacttttgcttttcacaagctcctacccgacaatattcaaggacagttttctccttacgatcggcaacaattcggacaggttttcagaggcccatattcccaggatctttcacacggactctggacggttttcaaaaacttcagatcgcgcacgacacgctctgatcagacacttcgcgatagaatcttgcaggtgatcataagagcggggtcccatgttgatgctttacaatttgtgtacgatcatgcgaatccaaattctacgactccggggactctggctggaaacgccacgggaggaattagacatcaggttaatgtgagggatccgcccatacaggaactgcgcatggagttcgctcgggatgtgcttgcttcgttgcagcttcatttcgcggatggtacatcaacacagaaattcggcaatgtaatttttggtacttgggcgactagaatactaacttgtacagcgccctatggctatagattcagctcatgggcctttcgtgaagatcccggcccctacagaacaaccgccatcagtgtactccgcttccaattcaccccagagctggatatgcccctcccctcagcgtatcttata

SEQ ID NO: 390 - DNA, 1335 bp, Pyrrosia rupestris
atggcaggatataatcacgtgcaggatcaattagtaatggcagctgatcaggacgttaatactgtttctgagcttgctcccgctactgataaggtgcagaacggtgacatggtcgaagaggacccaatttttgcgcaattagcggagctttttgaattcgaaatgcggctccttcagaacgacatcgaagcgctggaaatgactgttgggagatacgatacggctgcacttactgaaaaggggaactttctaagcatctggatctcgcaagctgatgcattgtatattcggatgcggaactctaccaacaacatccaccttctccttcacatggtcactgtgtctacacttcatatggcagccctgcatgagcgactgacatttggcgaggagctgtatggcacaaacaattcagcgaattggacggcagatcttgtggacaagttcgagaggtacacaaccgacttaatcccgaatgttttcaaaaggtggaaggaatggaggccaacccagatcgagattacagcacgacgacggaggggctcatgcggcattgttacttgtagtccaaacgtttcttatgctacagtggaggacaagatctccggggcaacattctcgtttcaggcaacaaatcaatactcgttaacaattttctcagaagtatgcgaagaccacaaaactcggatggtgaacgaggccgttgcagacatggcgagctgcctgtcaccaacttttgcttttcacaagctcctacccgacaatattcaaggacagttttctccttacgatcggcaacaattcggacaggttttcagaggcccatattcccaggatctttcacacggactctggacggttttcaaaaacttcagatcgcgcacgacacgctctgatcagacacttcgcgatagaatcttgcaggtgatcataagagcggggtcccatgttgatgctttacaatttgtgtacgatcatgcgaatccaaattctacgactccggggactctggctggaaacgccacgggaggaattagacatcaggttaatgtgagggatccgcccatacaggaactgcgcatggagttcgctcgggatgtgcttgcttcgttgcagcttcatttcgcggatggtacatcaacacagaaattcggcaatgtaatttttggtacttgggcgactagaatactaacttgtacagcgccctatggctatagattcagctcatgggcctttcgtgaagatcccggcccctacagaacaaccgccatcagtgtactccgcttccaattcaccccagagctggatatgcccctcccctcagcgtatcttata

SEQ ID NO: 391 - DNA, 1551 bp, Arthropteris tenella
atgccaggatatcacgtgcaggatcaattagtaatggcagctaaggacgttaatattgcttctgagcttgctcccgctgctgaggaggtgcagaacgcagacatggccgaggaggacccaattttctcgcaattagcgcagaagatggttgctgctgcggagagggaggaggtccccgtagatcttcttgctcaatacatgcaagtggaggctcatgactggcataaccggatcagaggcgccatactggggctgatatctgcagtgccgaaggtgggtgctgccataagcaggctcatcggcctcttttggccatcaaacaaggtggacatttgggaggccctcaatgcggaggaatatatcaggaacattgtccagcaggagctttttgaattcgaaatgcagctccttcggaacgacatcgaagcgttggaaaccactgttgtgagatacgatagggctgcacttactgagaaggggaattttctaagcatctggatctcgcaagccgatgcattgtatattcggatgcggaactctaccaacaacatccaccttcttcttcacatggtcaccgtgtctacacttcatatggcagccctgcatgagcgactgacatttggggaggaactctatggctcaaacaattcagcgaattggacgcaagatcttgtggataagtttgagatgtacacaaccgatttaatcccgaatgttttcaaaaggtggaaggactggaggccaacccagatcgtgattacagcatgggcacgcaatatgcaatgcggcaatcttacctgtagacctgcaatgtcttatgctacagtggaggataagatctccggagcactattctcgtttcaggcaacgaatcaaaattcaacaacaattttcttaggagtttgccaagatcacaaaactcggatggtgaacgaggccgttgcggacatggcaagctgcctgtcacccacttttgcctttcacaagctcctacccgatgatattcagacgcggttctctcctttcgatagggagcagttcggacaggttttcagaggcccatattcccaggatctttcgcacggattctggacggttcacaaagccttcagatcgcacacaactcgctcggatcagacaactcgcgatagaatcttggaggtgatcataagagcggggcaccatgttgatgctatacagttcctgtacgatcatgtgaatccaaatgctacgactccagggattatggctggaaactccgcgggagggattaggcatcaggttgatgtgagggatcggcgcatacaggatttgcgcatggagttctatcaggatgtgcttgcttcgttgcaacttcatttcgaggatggtacatcaacacggaaattcggcaatgaacttggttgggcaactaggatactaacttgtacagccccctatggctacaggttcagctcatgggcctttcgtgaagatcccggcccctacagaacacccgccatcagtgtactccgcttccaattcacccccgagctggatattcccttgcca

SEQ ID NO: 392 - DNA, 1530 bp, Stenochlaena palustris
atggcaacgaccgggatgaaggatacagcactgatcgtcgctgaggacaatgccactgttaaatctgacgtgcagcctgctgaggggttgctggacttgaactcgctcgctgctgctggtgttggtgctggtgatgaggtcaccacggacctgcttgccaaatacatggaaatggaggctcatgactggcataaccgggttagagctgccgtactggggctgatatccgcagtaccgaaggtgggggctgccgtaagcaagctcatcggcttcttttggccatcaaacaaggtggacatttgggaggccattaatgcggagcaatatgtgagaaacattgtgaagcaggagatttttgagttcgaaatgcagcaacatcagtccgacatcgaggcgctgcaaaccacagtttccagatacgacagggccgcgactactgagaaggggaattttctaagcatctggatctcgcaagctgacgcactgtgtattcggttgcgaaactcctccaacaacatccaccttcttcttcacatcgtcaccgtggctgtgcttcatgtcgcagccctgcatgagcgactggcattcggcgaggagctctacggctcaaacaatacagcaaattggacgaaagatctggtggatgtgttcgagatgtatacatccgatttgatcccaaatctcttcaaggagtggaggcagtggagggaaagccagattgagattagagcatgggtagtgccgggtcgatggggcaatcttgtttcaacaccagacgtttctcatgctacagtggaggataagatctcaggtgaaaaatttgcatttcaggttgcgagacaaaactcaacaacaattttcgcaaatgtttgcgaagatcacagaaatcggatgagtaatgaggccattgcagacatggctagctgcatctcacccacttttggttttcacaagctcctacctgacaatgttcaaacacaattctctccttacaatgaggagttgtttgggcaagttttcagaggtccatattcgcaagatctcatgcagccactcttcacgactctcaaaaccttcagaacaaggccaactcgctttgatcaaacagctcgcaacagaatcttggaggtgatcataagatcagggcaccatattgatgctatacaattttggtatgatcatgtaaatcccaactctatgacagcagggacaatggcaggaaactccgcagggggtagtaggcattgggttgatgtgagggatcggcccatacaggatctccgtatggagttctctcatgacgtgcttgcttcattgcaacttcattttgaagatggtacatcaacacgaaaatttggaaatgaacttggttgggctagtaatatagtaacttgtacaaccccttatggctacaggcttagctcatgggcctttcgtgaagatcctggcccctacagaacaactgccatcagtgtcctccgctttcaattcacccctgaggaattcacccctgaggatccctcatcacta

SEQ ID NO: 393 - DNA, 1530 bp, Stenochlaena palustris
atggcaacgaccgggatgaaggatacagcactgatcgtcgctgaggacaatgccactgttaaatctgacgtgcagcctgctgaggggttgctggacttgaactcgctcgctgctgctggtgttggtgctggtgatgaggtcaccacggacctgcttgccaaatacatggaaatggaggctcatgactggcataaccgggttagagctgccgtactggggctgatatccgcagtaccgaaggtggtggctgccgtaagcaagctcatcggcttcttttggccatcaaacaaggtggacatttgggaggccattaatgcggagcaatatgtgagaaacattgtgaagcaggagatttttgagttcgaaatgcagcaacatcagtccgacatcgaggcgctgcaaaccacagtttccagatacgacagggccgcgactactgagaaggggaattttctaagcatctggatctcgcaagctgacgcactgtgtattcggttgcgaaactcctccaacaacatccaccttcttcttcacatcgtcaccgtggctgtgcttcatgtcgcagccctgcatgagcgactggcattcggcgaggagctctacggctcaaacaatacagcaaattggacgaaagatctggtggatgtgttcgagatgtatacatccgatttgatcccaaatctcttcaaggagtggaggcagtggagggaaagccagattgagattagagcatgggtagtgccgggtcgatggggcaatcttgtttcaacaccagacgtttctcatgctacagtggaggataagatctcaggtgaaaaatttgcatttcaggttgcgagacaaaactcaacaacaattttcgcaaatgtttgcgaagatcacagaaatcggatgagtaatgaggccattgcagacatggctagctgcatctcacccacttttggttttcacaagctcctacctgacaatgttcaaacacaattctctccttacaatgaggagttgtttgggcaagttttcagaggtccatattcgcaagatctcatgcagccactcttcacgactctcaaaaccttcagaacaaggccaactcgctttgatcaaacagctcgcaacagaatcttggaggtgatcataagatcagggcaccatattgatgctatacaattttggtatgatcatgtaaatcccaactctatgacagcagggacaatggcaggaaactccgcagggggtagtaggcattgggttgatgtgagggatcggcccatacaggatctccgtatggagttctctcatgacgtgcttgcttcattgcaacttcattttgaagatggtacatcaacacgaaaatttggaaatgaacttggttgggctagtaatatagtaacttgtacaaccccttatggctacaggcttagctcatgggcctttcgtgaagatcctggcccctacagaacaactgccatcagtgtcctccgctttcaattcacccctgaggaattcacccctgaggatccctcatcacta

SEQ ID NO: 394 - DNA, 1542 bp, Elaphoglossum
atggcagcgcctggcctgatgagctcagctgttcacgatattgtctctgcgcgtgccaccactaagggggtgcctgacgttgtcgtcgaagatcatggcatccaaattctttctgtgtctgctgaggcagcggtggaagagacagacgttgtcgtagagcagccacagcgtgtgctacagcttcccgactactacattgaagtgaccgctgatgactggcataaccggattaggagcgccatcctacagttggcatccggtatccccgtagtgggtagtgccgtgagcattctcgttggcctcttttggccaagtaacaaggtgaacattttcgagtccatcaagggggagaaatacatcaggaacatcgtgaagcaggagctctttgaatatgagcttggggaacgcatctcggagatcgaggcgctggaagacactatcaagcaatacgatagggctgggccgagggagaaggcgggctttctgactgcctggctcacggactctaaccaattggctatacggttgcggaactctccgaacaacatccacctcctcctccacattgtcaccgtggccacgctccacatggcggccctgcatgagcggttgacgtttggcatggaactctaccaagaagacaatagaacgatttggagcgaggaccttgtgactgagttccgaaagtatgcattcgacgtactcccaactgtcttcggagtgtggaaggcatggagggaaagccaggttcagattgagacctggactagaaggggcggtggaaatattaactggactccggactcttcccatgccacggtggaggataagcactcaggggagattttccggtttacgcgaacttacatacggtcgacaaccatcttcttaccggtctgtgaggaccacaggactcggatgtggaacgaggctgttgcggacatggccagctacatatcacccacatttgcgtttcacaagctcctacctgatgatgtccagaggctgcaccctgcatatgatgagcagcagtttggtcgggttttcagaggtccctattcccgagaccttctatggaacaacgtctccggctcaggtgccatagacttcagatcaagtacagaccgcaatgatttcgttacgagtcgacacggtgtcgtcgaggtaactatacgaacagggcaccacgtcgacgcaatccagtttcggtatggtgccgcgaactcggggactctgctgggcgttatggcgggaaactcccgaggtggtaccctcaggcagttcgatgtgaggagccgggccatagaatcggtgcgcatggagttcgcgtacaacatacttgctgccatccaactcaattttgacgatggcaccaccacacggaggctcggcaatgagctggactggtcgacctgggtggtgactagtaccaccccttttggctacacactcagctcgtgggcctaccgccaagataacggcccctacggaacagccgcgcccagcgtgctccgcttccaatatgcccccccgatagaaccc

SEQ ID NO: 395 - DNA, 1542 bp, Elaphoglossum
atggcagcgcctggcctgatgagctcagctgttcacgatattgtctctgcgcgtgccaccactaagggggtgcctgacgttgtcgtcgaagatcatggcatccaaattctttctgtgtctgctgaggcagcggtggaagagacagacgttgtcgtagagcagccacagcgtgtgctacagcttcccgactactacattgaagtgaccgctgatgactggcataaccggattaggagcgccatcctacagttggcatccggtatccccgtagtgggtagtgccgtgagcattctcgttggcctcttttggccaagtaacaaggtgaacattttcgagtccatcaagggggagaaatacatcaggaacatcgtgaagcaggagctctttgaatatgagcttggggaacgcatctcggagatcgaggcgctggaagacactatcaagcaatacgatagggctgggccgagggagaaggcgggctttctgactgcctggctcacggactctaaccaattggctatacggttgcggaactctccgaacaacatccacctcctcctccacattgtcaccgtggccacgctccacatggcggccctgcatgagcggttgacgtttggcatggaactctaccaagaagacaatagaacgatttggagcgaggaccttgtgactgagttccgaaagtatgcattcgacgtactcccaactgtcttcggagtgtggaaggcatggagggaaagccaggttcagattgagacctggactagaaggggcggtggaaatattaactggactccggactcttcccatgccacggtggaggataagcactcaggggagattttccggtttacgcgaacttacatacggtcgacaaccatcttcttaccggtctgtgaggaccacaggactcggatgtggaacgaggctgttgcggacatggccagctacatatcacccacatttgcgtttcacaagctcctacctgatgatgtccagaggctgcaccctgcatatgatgagcagcagtttggtcgggttttcagaggtccctattcccgagaccttctatggaacaacgtctccggctcaggtgccatagacttcagatcaagtacagaccgcaatgatttcgttacgagtcgacacggtgtcgtcgaggtaactatacgaacagggcaccacgtcgacgcaatccagtttcggtatggtgccgcgaactcggggactctgctgggcgttatggcgggaaactcccgaggtggtaccctcaggcagttcgatgtgaggagccgggccatagaatcggcgcgcatggagttcgcgtacaacatacttgctgccatccaactcaattttgacgatggcaccaccacacggaggctcggcaatgagctggactggtcgacctgggtggtgactagtaccaccccttttggctacacactcagctcgtgggcctaccgccaagataacggcccctacggaacagccgcgcccagcgtgctccgcttccaatatgcccccccgatagaaccc

SEQ ID NO: 396 - DNA, 1542 bp, Elaphoglossum
atggcagcgcctggcctgatgagctcagctgttcacgatattgtctctgcgcgtgccaccactaagggggtgcctgacgttgtcgtcgaagatcatggcatccaaattctttctgtgtctgctgaggcagcggtggaagagacagacgttgtcgtagagcagccacagcgtgtgctacagcttcccgactactacattgaagtgaccgctgatgactggcataaccggattaggagcgccatcctacagttggcatccggtatccccgtagtgggtagtgccgtgagcattctcgttggcctcttttggccaagtaacaaggtgaacattttcgagtccatcaagggggagaaatacatcaggaacatcgtgaagcaggagctctttgaatatgagcttggggaacgcatctcggagatcgaggcgctggaagacactatcaagcaatacgatagggctgggccgagggagaaggcgggctttctgactgcctggctcacggactctaaccaattggctatacggttgcggaactctccgaacaacatccacctcctcctccacattgtcaccgtgaccacgctccacatggcggccctgcatgagcggttgacgtttggcatggaactctaccaagaagacaatagaacgatttggagcgaggaccttgtgactgagttccgaaagtatgcattcgacgtactcccaactgtcttcggagtgtggaaggcatggagggaaagccaggttcagattgagacctggactagaaggggcggtggaaatattaactggactccggactcttcccatgccacggtggaggataagcactcaggggagattttccggtttacgcgaacttacatacggtcgacaaccatcttcttaccggtctgtgaggaccacaggactcggatgtggaacgaggctgttgcggacatggccagctacatatcacccacatttgcgtttcacaagctcctacctgatgatgtccagaggctgcaccctgcatatgatgagcagcagtttggtcgggttttcagaggtccctgttcccgagaccttctatggaacaacgtctccggctcaggtgccatagacttcagatcaagtacagaccgcaatgatttcgttacgagtcgacacggtgtcgtcgaggtaactatacgaacagggcaccacgtcgacgcaatccagtttcggtatggtgccgcgaactcggggactctgctgggcgttatggcgggaaactcccgaggtggtaccctcaggcagttcgatgtgaggagccgggccatagaatcggtgcgcatggagttcgcgtacaacatacttgctgccatccaactcaattttgacgatggcaccaccacacggaggctcggcaatgagctggactggtcgacctgggtggtgactagtaccaccccttttggctacacactcagctcgtgggcctaccgccaagataacggcccctacggaacagccgcgcccagcgtgctccgcttccaatatgcccccccgatagaaccc

SEQ ID NO: 397 - DNA, 1563 bp, Myriopteris
atggcagctgatcagaccgacgttaatactagtgctgtggctgatgaccaggaggacttgcaggatgcagacagctgcaaggaggacccagattattcgcaagtagcgcaagcgatggtcgcagctggtgctgctgctgctgcggaggggaaggaggtcggcctcgtagatgtgattgacaaatacatgcatatacaggctcatgactggcataatcggattagaggcgctttactggcgctgctatccaagatcccgacggtgggttctgccgtcagcatgctggtcggcttcttttggccagcaaacagggtggacatttgggaggccatcaaagcggaggagcgtgtgaggaacattgtccagcaggagcttttcgaattcgaaatgcagctactaaaggacgaaatcgaagcgctggaaaccgttgttgcgagatacaacaatacggctgtgctcactgagaaggggaactttttaagtatctggatcacgcaagctgacagattgtatattcgcatgcgaaactctgccaacaacatccaccttctccttcacattgtcactgtgtctgtgcttcatgtcgcaggcctacatgagcgactgacatttggcgagcagctctatggcgcaagcaataccgcaaattggacgcaagatcttgtgactgtggtccggtcgtacacagtcgatttaatcccagatctgttcaagaagtggaaggagtggagggagtcccagatcgagattagagcatgggtagtgaggggcacatgcggatttcttaattgtagaccagacgtgtctcatgcgacagtggaggataagatgtcaggggcgatattcaggtttcaggcaacgaatcgaaactccacaaccatcttctcaggaatttgccaagatcacaaaattcggatggctaatgacgccatcgcggacatggccggctgcctgtcacccacttttgctttgcacaagctccttcccttgcatagtcaggggcagttctctgcttatgacagggagcaattcgggcgcattttcagagggccatattcccaggatcttacgcacggcctctttacatttgtgaaagccttcaggtccaatataactatgccggatgaaacgtcgagtcgcgacagagtcttggaggtgaccattcgagcgggggcccatgttgacgctatccaattttggtacgaccatgtgaatccaaacgctatgactgcagggattctggccggaaactcattggggggtagcaggcatcaggttgatgtgaggcagcgcgccattcaggacttgcgcatggagttctcctatgacgtgcttgcgtcgttgcaactgcatttcgaggatggtagctcaacagcaaaatttggcaatgccgagaactgggcgactcgtatagtaacgtgttcaaccccccttggctacagggtcagctcatggggctttcgtgtagatgccggcccctacggactctccatcagtgtgctccgcttccaattcaccccggagctggactacattgcgcccccacccaactccctaactaat

SEQ ID NO: 398 - DNA, 1611 bp, Myriopteris
atggcagctgatcagaccgacgttaagaccgacgttaatactagtggtgtggctgctgatcagaccgacgttaatactagtgctgtggctgatgaccaggaggacttgcaggatgcagacagctgcaaggaggacccagattattcgcaagtagcgcaagcgatggtcgcagctggtgctgctgctgctgcggaggggaaggaggtcggcctcgtagatgtgattgacaaatacatgcatatacaggctcatgactggcataatcggattagaggcgctttactggcgctgctatccaagatcccgacggtgggttctgccgtcagcatgctggtcggcttcttttggccagcaaacagggtggacatttgggaggccatcaaagcggaggagcgtgtgaggaacattgtccagcaggagcttttcgaattcgaaatgcagctactaaaggacgaaatcgaagcgctggaaaccgttgttgcgagatacaacaatacggctgtgctcactgagaaggggaactttttaagtatctggatcacgcaagctgacagattgtatattcgcatgcgaaactctgccaacaacatccaccttctccttcacattgtcactgtgtctgtgcttcatgtcgcaggcctacatgagcgactgacatttggcgagcagctctatggcgcaagcaataccgcaaattggacgcaagatcttgtgactgtggtccggtcgtacacagtcgatttaatcccagatctgttcaagaagtggaaggagtggagggagtcccagatcgagattagagcatgggtagtgaggggcacatgcggatttcttaattgtagaccagacgtgtctcatgcgacagtggaggataagatgtcaggggcgatattcaggtttcaggcaacgaatcgaaactccacaaccatcttctcaggaatttgccaagatcacaaaattcggatggctaatgacgccatcgcggacatggccggctgcctgtcacccacttttgctttgcacaagctccttcccttgcatagtcaggggcagttctctgcttatgacagggagcaattcgggcgcattttcagagggccatattcccaggatcttacgcacggcctctttacatttgtgaaagccttcaggtccaatataactatgccggatgaaacgtcgagtcgcgacagagtcttggaggtgaccattcgagcgggggcccatgttgacgctatccaattttggtacgaccatgtgaatccaaacgctatgactgcagggattctggccggaaactcattggggggtagcaggcatcaggttgatgtgaggcagcgcgccattcaggacttgcgcatggagttctcctatgacgtgcttgcgtcgttgcaactgcatttcgaggatggtagctcaacagcaaaatttggcaatgccgagaactgggcgactcgtatagtaacgtgttcaaccccccttggctacagggtcagctcatggggctttcgtgtagatgccggcccctacggactctccatcagtgtgctccgcttccaattcaccccggagctggactacattgcgcccccacccaactccctaactaat

SEQ ID NO: 399 - DNA, 1548 bp, Drynaria sparsisora
atggtagcctcggacatgaaggactcagaaatgatcggtggcgacgtcgctcctgctacacttgtttctgaggagaatgcacaaacgatcgccgaggacgctaataatacaacggttggttctgaggccgccggggagctggataagctggcgctggagggcggcgacaatgtcgtcgatgtgcttgccagacagatgcaagtggaggctcacgactggcataaccgcgtgagaggcgctgtgctggggctcacatcggcagtgccgatggtgggtagagccataagcaacctcatcggcctcttttggccagcaaacagggtgaacatttgggaggctctcaacgcggaggcatacattacgaacattgtccggcgggagatttttgagttcgaaatgaggctgcacgagtccgacatcgaggctctggagaggaccattttgagatatgatagggcctcgcttcttcatgagaaggggatttttctagccaattggatcgttcaagcggacgcactgtgtattcggttgcgaaactccaccaacaggattcatcttctccttcatattgttaccgtggctgtgcttcacatggccgccctgcatgagcgactgacatttggcgaggaactttacggcgcaaacaatacagcgaattggacaaccgaactcgtggaacagttcgagaggtacacgatcgataaagtcccaaacatctttgaggagtggaggccgtggagggaaagtcagattcagatcacagaatggagggtagcgggtcaatgtggcaatcttacttgtcgtccagccgtttctcatgcaacagtggaggataaggtctcaggggaaacattcgtgtttcgcgccaccaacgttttctcgacaacgattttctcagatctctgtcgagatcacagaacacgaatgatgaatgaggccgttgcagacatggcaagctgtatgtcgcccacttttgcttttcacaccctcctacccaccagtgacattcaaatgcagttcagtcctttcgataggcgggtgtttgggcaagtttttcgaggcccatattcatggcatcttctgcaacatcaattattttacacgtcgggacgcatctccttcataacgcgcccaactcgttttgatcaaacggatcgcgacagagtcttacaggtgactatatcagaggggttacgtcttgaagggatgcaattttggtacgatcacgcagatccaagtgctatgactccggggatgatggcgggaaactttacagtagggaggccgattatagttgacgttgatgtgaggaatcgacccatacaacatttgcacatggagtttgccacagatgggttggtttcgttacagatacagtttgaagatgggacatcaacacggaaattcggcaatggaatgtcacattggattggtgataaagtagcttgtacaaccccctctggctacaggctcagttcatgggcttgtacaaccccgtctaccttcgatctcgttcgcttcgaattcacccccgagattccctcgacc

SEQ ID NO: 400 - DNA, 1548 bp, Drynaria sparsisora
atggtagcctcggacatgaaggactcagaaatgatcggtggcgacgtcgctcctgctacacttgtttctgaggagaatgcacaaacgatcgccgaggacgctaataatacaacggttggttctgaggccgccggggagctggataagctggcgctggagggcggcgacaatgtcgtcgatgtgcttgccagacagatgcaagtggaggctcacgactggcataaccgcgtgagaggcgctgtgctggggctcacatcggcagtgccgatggtgggtagagccataagcaacctcatcggcctcttttggccagcaaacagggtgaacatttgggagactctcaacgcggaggcatacattacgaacattgtccggcgggagatttttgagttcgaaatgagactgcacgagtccgacatcgaggctctggagaggaccattttgagatatgatagggcctcgcttcttcatgagaaggggatttttctagccaattggatcgttcaagcggacgcactgtgtattcggttgcgaaactccaccaacaggattcatcttctccttcatattgttaccgtggctgtgcttcacatggccgccctgcatgagcgactgacatttggcgaggaactttacggcgcaaacaatacagcgaattggacaaccgaactcgtggaacagttcgagaggtacacgatcgataaagtcccaaacatctttgaggagtggaggccgtggagggaaagtcagattcagatcacagaatggagggtagcgggtcaatgtggcaatcttacttgtcgtccagccgtttctcatgcaacagtggaggataaggtctcaggggaaacattcgtgtttcgcgccaccaacgttttctcgacaacgattttctcagatctctgtcgagatcacagaacacgaatgatgaatgaggccgttgcagacatggcaagctgtatgtcgcccacttttgcttttcacaccctcctacccaccagtgacattcaaatgcagttcagtcctttcgataggcgggtgtttgggcaagtttttcgaggcccatattcatggcatcttctgcaacatcaattattttacacgtcgggacgcatctccttcataacgcgcccaactcgttttgatcaaacggatcgcgacagagtcttacaggtgactatatcagaggggttacgtcttgaagggatgcaattttggtacgatcacgcagatccaagtgctatgactccggggatgatggcgggaaactttacagtagggaggccgattatagttgacgttgatgtgaggaatcgacccatacaacatttgcacatggagtttgccacagatgggttggtttcgttacagatacagtttgaagatgggacatcaacacggaaattcggcaatggaatgtcacattggattggtgataaagtagcttgtataaccccctctggctacaggctcagttcatgggcttgtacaaccccgtctaccttcgatctcgttcgcttcgaattcacccccgagattccctcgacc

SEQ ID NO: 401 - DNA, 1524 bp, Thelypteris noveboracensis
atggcagcgcccgccatggtgcactcagaaatgatcgctgaggacgttaatactgtttctgtgcttgctccgccagctgaggagctgcaggactcagtttatacgcaattagcgcaacagatgatcgctgctcaggaagctgggcaggaggtcaccgtagatctgcttgccaaatacatgcaaatcgaggctcatgactggcataaccggactagacgcgctatactggggctgatatccctagccgggacggtgggtgctggcgtaagcatgctcatcagcctcttttggccagcaaccaaggtggacatttgggaggccatcaatgggaaccaatatgttaggaacattatcaggcaggagatttttgaattcgaattgcatcaacatcggtccgaaatccaggcgctggaaaccactgtttcgagatacaatacggctggtgggcctattgagaggggcaattttctaagcctctggatcacgcaagctgacagattgtctattctgttgcgaaactctaccaacaacatccaccttctccttcacattgtcaccgtggccgtgcttcatgtcgcagccctgcatgagcgactgacatttggcaaggaactctatggccaagacaatacagcaaattggaagcaagatcttgtggatgtgttcgagatgtacacatccaatgcactcccaaatatcttcaacaagtggaaggagtggagggcaaccgagattgagattacagcatggagagtaagggcccaacacggcaatcttatttatagaccaagcagttcccatgctacagtggaggataagatctcaggggagaaattcaggtttcaggtaacctctgaatactcaacaacaattttctcagaagtttgccaagatcacaaaactcggatgatgaacgaggccattgcggacatggccagctgcttgtcacccacttttgcttttcacaagctcctaccggacgatattcagacgcagttctctccttatgatgaggtggcgttcgggcgagttttcagaggcccatattcccaggatcttttgcagtcagccttcacaagattcaaagccttcagatcgcgtgcaactcgctttgatcagacgactcgcgacagaatcttgcaggtgatcataagagcggggaaccttgttgatgctatacaattttggtacgataattggaatccaaatgctatgacggcagggattatggccggacaccctacgggggggactaggcatcaggttgatgtgagggatcggcccatacaggaattgcgcatggggttcgcttctgacgtgcttacttggttgcagcttcgtttcgaagatggtacatccacacagcaatttggcagtagtggttgggcgtctaatatagtaacttgtacagccccctatggctacaggctcagctcatgggcctttcgtgaagatcccggccccttcagcacacccgccatcagtgtactgcgcttccaattcacccccgacgatattcgtgac

SEQ ID NO: 402 - DNA, 1524 bp, Thelypteris noveboracensis
atggcagcgcccgccatggtgcactcagaaatgatcgctgaggacgttaatactgtttctgtgcttgctccgccagctgaggagctgcaggactcagtttatacgcaattagcgcaacagatgatcgctgctcaggaagctgggcaggaggtcaccgtagatctgcttgccaaatacatgcaaatcgaggctcatgactggcataaccggactagacgcgctatactggggctgatatccctagccgggacggtgggtgctggcgtaagcatgctcatcagcctcttttggccagcaaccaaggtggacatttgggaggccatcaatgggaaccaatatgttaggaacattatcaggcaggagatttttgaattcgaattgaatcaacatcggtccgaaatccaggcgctggaaaccactgtttcgagatacaatacggctggtgggcctattgagaggggcaattttctaagcctctggatcacgcaagctgacagattgtctattctgttgcgaaactctaccaacaacatccaccttctccttcacattgtcaccgtggccgtgcttcatgtcgcagccctgcatgagcgactgacatttggcaaggaactctatggccaagacaatacagcaaattggaagcaagatcttgtggatgtgttcgagatgtacacatccaatgcactcccaaatatcttcaacaagtggaaggagtggagggcaaccgagattgagattacagcatggagagtaagggcccaacacggcaatcttttttatagaccaagcagttcccatgctacagtggaggataagatctcaggggagaaattcaggtttcaggtaacctctgaatactcaacaacaattttctcagaagtttgccaagatcacaaaactcggatgatgaacgaggccattgcagacatggccagctgcttgtcacccacttttgcttttcacaagctcctaccggacgatattcagacgcagttctctccttatgatgaggtggcgttcgggcgagttttcagaggcccatattcccaggatcttttgcagtcagccttcacaagattcaaagccttcagatcgcgtgcaactcgctttgatcagacgactcgcgacagaatcttgcaggtgatcataagagcggggaaccttgttgatgctatacaattttggtacgataattggaatccaaatgctatgacggcagggattatggccggacaccctacgggggggactaggcatcaggttgatgtgagggatcggcccatacaggaattgcgcatggggttcgcttctgacgtgcttacttggttgcagcttcatttcgaagatggtacatccacacagcaatttggcagtagtggttgggcgtctaatatagtaacttgtacagccccctatggctacaggctcagctcatgggcctttcgtgaagatcccggccccttcagcacacccgccatcagtgtactgcgcttccaattcacccccgacgatattcgtgac

SEQ ID NO: 403 - DNA, 1524 bp, Thelypteris noveboracensis
atggcagcgcccgccatggtgcactcagaaatgatcgctgaggacgttaatactgtttctgtgcttgctccgccagctgaggagctgcaggactcagtttatacgcaattagcgcaacagatgatcgctgctcaggaagctgggcaggaggtcaccgtagatctgcttgccaaatacatgcaaatcgaggctcatgactggcataaccggactagacgcgctatactggggctgatatccctagccgggacggtgggtgctggcgtaagcatgctcatcagcctcttttggccagcaaccaaggtggacatttgggaggccatcaatgggaaccaatatgttaggaacattatcaggcaggagatttttgaattcgaattgcatcaacatcggtccgaaatccaggcgctggaaaccactgtttcgagatacaatacggctggtgggcctattgagaggggcaattttctaagcctctggatcacgcaagctgacagattgtctattctgttgcgaaactctaccaacaacatccaccttctccttcacattgtcaccgtggccgtgcttcatgtcgcagccctgcatgagcgactgacatttggcaaggaactctatggccaagacaatacagcaaattggaagcaagatcttgtggatgtgttcgagatgtacacatccaatgcactcccaaatatcttcaacaagtggaaggagtggagggcaaccgagattgagattacagcatggagagtaagggcccaacacggcaatcttatttatagaccaagcagttcccatgctacagtggaggataagatctcaggggagaaattcaggtttcaggtaacctctgaatactcaacaacaattttctcagaagtttgccaagatcacaaaactcggatgatgaacgaggccattgcggacatggccagctgcttgtcacccacttttgcttttcacaagctcctaccggacgatattcagacgcagttctctccttatgatgaggtggcgttcgggcgagttttcagaggcccatattcccaggatcttttgcagtcagccttcacaagattcaaagccttcagatcgcgtgcaactcgctttgatcagacgactcgcaacagaatcttgcaggtgatcataagagcggggaaccttgttgatgctatacaattttggtacgataattggaatccaaatgctatgacggcagggattatggccggacaccctacgggggggactaggcatcaggttgatgtgagggatcggcccatacaggaattgcgcatggggttcgcttctgacgtgcttacttggttgcagcttcgtttcgaagatggtacatccacacagcaatttggcagtagtggttgggcgtctaatatagtaacttgtacagccccctatggctacaggctcagctcatgggcctttcgtgaagatcccggccccttcagcacacccgccatcagtgtactgcgcttccaattcacccccgacgatattcgtgac

SEQ ID NO: 404 - DNA, 1524 bp, Thelypteris noveboracensis
atggcagcgcccgccatggtgcactcagaaatgatcgctgaggacgttaatactgtttctgtgcttgctccgccagctgaggagctgcaggactcagtttatacgcaattagcgcaacagatgatcgctgctcaggaagctgggcaggaggtcaccgtagatctgcttgccaaatacatgcaaatcgaggctcatgactggcataaccggactagacgcgctatactggggctgatatccctagccgggacggtgggtgctggcgtaagcatgctcatcagcctcttttggccagcaaccaaggtggacatttgggaggccatcaatgggaaccaatatgttaggaacattatcaggcaggagatttttgaattcgaattgcatcaacatcggtccgaaatccaggcgctggaaaccactgtttcgagatacaatacggctggtgggcctattgagaggggcaattttctaagcctctggatcacgcaagctgacagattgtctattctgttgcgaaactctaccaacaacatccaccttctccttcacattgtcaccgtggccgtgcttcatgtcgcagccctgcatgagcgactgacatttggcaaggaactctatggccaagacaatacagcaaattggaagcaagatcttgtggatgtgttcgagatgtacacatccaatgcactcccaaatatcttcaacaagtggaaggagtggagggcaaccgagattgagattacagcatggagagtaagggcccaacacggcaatcttatttatagaccaagcagttcccatgctacagtggaggataagatctcaggggagaaaatcaggtttcaggtaacctctgaatactcaacaacaattttctcagaagtttgccaagatcacaaaactcggatgatgaacgaggccattgcggacatggccagctgcttgtcacccacttttgcttttcacaagctcctaccggacgatattcagacgcagttctctccttatgatgaagtggcgttcgggcgagttttcagaggcccatattcccaggatcttttgcagtcagccttcacaagattcaaagccttcagatcgcgtgcaactcgctttgatcagacgactcgcgacagaatcttgcaggtgatcataagagcggggaaccttgttgatgctatacaattttggtacgataattggaatccaaatgctatgacggcagggattatggccggacaccctacgggggggactaggcatcaggttgatgtgagggatcggcccatacaggaattgcgcatggggttcgcttctgacgtgcttacttggttgcagcttcatttcgaagatggtacatccacacagcaatttggcagtagtggttgggcgtctaatatagtaacttgtacagccccctatggctacaggctcagctcatgggcctttcgtgaagatcccggccccttcagcacacccgccatcagtgtactgcgcttccaattcacccccgacgatattcgtgac

SEQ ID NO: 405 - DNA, 1497 bp, Pteris ensiformis
atggccggcataaaggactcagaaatgattggtgacgtcgtcgttacccctactgctgtttctgtgcctgctggggagctggaggtgcaggacctggatcaattggggctggaggtcaccaataacatagatgtgcttgccaaatacatgcaaatggaggctcatgactggcataaccggacgagaggcgctgtactggggctcatatccgcaatcccgaaggtgggtgctgccataagcatgctcatcggcctcttttggccagcgaacaaggtggacatttgggtggccctcaatgcggaggaatatgtaagaaacattgtgaagcaggagatttttgaattcgaaatgcagcaacatcagtccgaaatcgaggcgctggaagccaccattttgagatatgatagggctgcgcttactgagaagcggaattttctaagcatctggatctcacaagctgacagactgtgtattcggttgcgaaattcttccaacaacatccaccttctccttcacattgtcaccgtggctgtgcttcatattgccgccatgcatgagcgactgacatttggcgaggaactctatggcaccaaccatacaacaaattggacaaaagatcttgtggatgtgttcgagatgtacacatctaatttaatcccaaatatcttcaagcagtggcggcagtggagggaaagcgaaattgagattaaagcatgggtagtaagaggtgtatggggcaatcttactcagaccccagacgtttctcatgcaacagtggaggataagatctcaggagagaaattcacgtttcgggcaacgagacaaaactcgacaacaattttctcagatgtatgccaagctcacaaaactcggatggcgaatgaggccgttgcagacatggccagctgcatgtcacccacttttgcttttcacaagctcctacctaacaatattcaaacacaattctctccttacgataaggatctgtttgcgcaagtttttcgcggcccatattcacaggatctcttgcagccactcttcacggctctcaaatccttcagaacacgtccaactcgctttgatcaaacggctcgcgacaaaatcttggaggtgactataagagcgggccaccatattgatgccatacaattttggtacgatcatgtgaatccaaatactatgactgcagggactatggccggaaactctacaggggggagtaggcatcaagttaatgtgaggaatcaacgcatacaggatttacgcttggagttctcccaagacgtgcttgcttcattgcaacttcatttcgaagatggtacatcaacacgaaaatttggcaatgaaatgggctgggctagtagaatagtaacttgtacaacccccgctggctacaggctcagctcatgggcctttcgtgaagatcgtggtccctacaatacaactgccatcagtgttctccgcttccaattcacccctgatgaggatgcctcatca

SEQ ID NO: 406 - DNA, 1521 bp, Polystichum tripteron
atggcagcgcccggcatgatggactcagaaatgatcgctgaggacgttcatgatgtgcttgctccggctcctgaggtggaggtgcaggactcagtttatccgcaattagcgcaagagatgatcgctgacgctgctgcggaggaggtcaccgtagatcgccttgccaaatacatgcaagtcgaggctcatgactggcataaccggactagaggtgctatactggggctcatatcggcaatcccgaaggtgggtgctggcataagcttcctcatcggcctcttttggccagcaaacaaggtggacatttgggaggccatcaatgcggagcaatatgttcggaacattgtcaagcaggagatttacgaattcgaattgcggcaacttcgctccgacatcgaggcgctgcaaaccactgtagggagatacgatacggctgcgcctaatgagagggggcattatctaagcaactggatcacgcaagctgacatattgtattttcggatgcgagactctaccaacaacatccaccttctccttcacattgtcaccgtggctgtgcttcatatcgcagctctgcatgaacgactgacatttggcgaggaactctacggcgcaaacaatacagcaaattggacgcgagctcttgtggaagtgttcgagatgtacacatccaatttaatcccaaatctcttcaacaagtggaaggagtggagggaaagccagattgtgattacagcatggagagtaaggggccaatcaggccttactatttttagaccagacgtttctcatgctacagtggaggatacagtctcaggggagaaattcacatttcaggcatcctaccattactcaacaacaattttctcagaagtttgcagagatcacaaaactcggatgacgaacgaggccattgcggacatggcgagctgcttgtcacccacttttgctttccacaagctcctaccggacgatattcagacacagttctctccttatgataggggcgcgttcggggcggttttgagaggcccatattcctgggatctatcgcagccactcttcacgactctcaaagccttcagatcacgtccaactcgctttgatcagacggctcgcgacagagtcttggaggtgatcataagagcggggcaccatgttgatgctgtacaatttttttacgatcatgcgagtccaaatggtacaactgcagggactatggccggaaactctgcgggggggagtaggaatgtggttgatgtgaggagtcggagcatacagaaattgcgcatgggcttctctcgtgacgtgcttgcttcgttgcaacttcagttcgaagatggtacatccacccgccaatttggcaatgaactgggttgggcgtctactatagtaacttgtacagccccctttggctacaggctcagctcatgggcctttcgtgaagatcccggcccctacaacacaaccgccattagtctactccgcttccaattcacccccgacgatattccctcctca

SEQ ID NO: 407 - DNA, 1581 bp, Asplenium athertonense
atggattccgatacgattgtcgatgcgcctcaggcagacgtcaacgctgcttctgtgcaagccccggctgcaaagaaggttcatgaggatcaatcggtaatgacgacgcctgatcaaatggaggagtcagtcgatccgcaattcgaacaagaaatgagcagtgtttctgcgcttatcgctgcgggcgcagtggaggggcatgatgatgtagatcttttcgagaaatatatgcacgtcgaggctcatgactggcagaaccggcttaggcaagctatactggggctagcatctaaaatcccaaaggtggggtttgcgataagtgcgctcattggcctcttttggccaccaaaccgggtgagtatttgggaggccatcaatggggaagtatatgttcgaaacattgtccggcaggagctgttcgaatttgaagtgcggcttcttaagtccgacatcgaggcgctggaaaccgtaattcacagatacgatcaggccgcttcaactcttgagaaggggaattttctgagcatctggatctcgcaggctgacggtttgcttattcgcatgcgccgctctaccaataacatccacctcctccttcacattgtgaccgtggctgtgctccatatggcagctctgcatgagcggctgacttttggcgaagaactctacggctcaaacaatacagcaaattggaagcaagctcttgtggaaatgtttgaggagtacacaatcaatttaatcccaactctctttagggagtggaggcagtggcgggatagccagattgagattaggcaatgggcagtgaggggtcgatggggcaatgttgttgcttctccagacagttcgcatgctactgtggaggataaattcgcaaggcaactgttcacattccgggtgatccgtcgatactcgacaacaattttctcgggagtgacccaagatcagaggacgcggatgatgaatgaggccactgcggacatggctagctgcatatcgcccacttttgctttccacgagatcctacccaacgatgttaagacacggttttccccttatgacaaggagctgttcggccgggtgttcagaggcccatactctcaggatcttatgcagccacttttcacgactttcagagacttcagatcacatccgaggcgctctgatccgacgactcctggcagagtcgtagaggtgactatacgggcggggcaccatgttgatgctatacagctttggtacgatcatgcgaattcgaactctgcaaccgcaggcctaatggctggaaatcctaccggggggactaggcatcagattaatgtgagggaccggcccatacaacagtttcgcatggagtttgctcacgacacgctcgcctcattgcagcttcatttccaggatggtacatccacgcggaaatttggcaatgagcttggttgggcatctagaatagcaacttgcacagccccttatggctacaagctcagctcatgggccttccgtgaagatcccggcccctacgggaccgctgccatcagtttgttgcgcttcgatttcactcctgaacatccctcttccata

SEQ ID NO: 408 - DNA, 1494 bp, Lindsaea brachypoda
atggcagcgcccgccggcacgacggactcagaagtgatcgctgacgttgttactcctgctgctgctgctgctggggaggtgctggacctggatcgattgggactggagctcaccagcaacaatatagatgtgctcgccaaatacatgcaaatggaggcgcatgactggcataaccggatgagagacgctgtactggcgctcatgtcccaaatcccgacggtgggtggtgccgtaagcatgctcatcggcctcttttggccagcgaaaaaggtgaacatttggctggcgctcaacgcggaggcgtatgtaagaaacattgtcaagcaggagatcttcgaattcgaaatgcagcagcatcagtcctccatcgaggcgctggaagccactatttcgagatacgatagggctgtgcttactgagaaggggaattttctaagcatttggatctcgcaagcggacgcgctgattattcggctgcgaaactctaccaacaacatccaccttctccttcacattgccactgtagctgtgcttcatgtcgccgccatgcatgagcgattaacatttggcgaggaactctacggtacaaacaatacagcaaattggaggaaagattttgtggatgtgttccagatgtacacatccaatttagtcccaaatgtcttcaaggagtggaagcagtggagggaaaatgagattgagattaaagcatgggtagtaaagggtgtatggggcactgttgtttccaccccagacgtatctcatgcaacagtggaggataagttctcaggggagaaattcacatttcgagtagcacgacaaaactcaacaacaattttctcaaatgtttgccaagatcacaaaactcgaatgatgaatgaggccatcgcagacatggctagctgcatgtcacccacttttgcttttcacaaactcctacccagcgatattcagacacagttccctccttatgacaagaagctttttgggcaagttttccgaggcccatattcccaagatcttttgcagccactgttcacgaatctcaaatccttcagaacacgtccaactcgctttgatcaaacagctcgggacagaatcttggaggtgattataagagcagggcaccatgttgatgctatacaattctggtatgatcatgtgaatccaaatgctatgactgcagggactatggctggaaactctacagggggaagtaggcatcaggttgatgtgaggaatcgacgcatacaggatttgcgattggagttctctcaagatgtgattgcttcattgcaaattcatttcgaagatggtacatcaacacggaaatttggtaatgaaatgggttgggctactaatatagtcacttgtacaacccccgctggctacaggctcagctcatgggcatttcgtgaagatctcggtccctatacaacaaccgccatcagtgttctccgcttccagttcacccccgaggatccctcgccataa

SEQ ID NO: 409 - DNA, 1416 bp, Adiantum aethiopicum
atgcaggcagctgcagctgtgaaggggcaggagcttcccgtggtagacctgatagacaaatacatgcaagtgcaggctcacgactggcataaccggattagaggcgccatcttagggctgatatccttagtgccggttgtcggtagaggggtcagcaagcttgtcggcctcttttggccaaccaccaaggtagacatttgggaggccctcaagatggagcaatatatccggaacattgtccagcaggagatttttgaatttgaaatgcgtcagcttcagtccgacatcgaagcgctggaaacaactgttgggagatacgatagggctacgtctcttattgagaagggcaatttcttgagtatctggatcacacaagctgatgcattatattttcgtatgcgagactctaccaacaacatccacctcctccttcacattgtcaccgtgtctacgcttcacatcgcagccctacatgagcgattgacatttggcgaggaactctatggttcaaacaatgcggcaaattggacgcgagatctcgtggataagttcagactgtacacagttgatttgctcccaagtatttttcagaggtggaaggtatggagggaagcccagattgagattagagcatggatagactggggctcctgtggcaatcttacttgtagaccaaatgtttctcatgcaaccgtacacgacaaagtctcaggggtggtattggcattccgggcacaaaaccgagcttcgacaacaatattctcaggcctttgtgaaggtcacaaaactcggatgcggaacgaggctgttgccgacatggccagctgcctttcacccacgtttgcttttcacaagctcctacccgacaacattcagccgcagttttctgcattcgacaggcagcagttcgggcaggttctcagaggtccatattcgcaggatctttcgtatgaagcattgacgatgaatgttctgaaatccttcagaacgagcgcgacgaccttcgatcaggcagcgggcagagttgtggaggtgaacataagatcagggcaccatgtcgatgctatacggtttttttacgaccatttggcaggaatcatggctggaaactctgggggagggactagccatcaggttgatgtgaggggtcgcctcatacaggatttgcgcatggagttctctcacgacatacttgcagcattgcaactgcatttccaagatggcacatctacacggaaatttggcaacgagcttggctgggcatctcgagtattaacttgtactgctccttatggttacagcctcagctcatggggtttccgccaagatgaaggcccctaccgaacggccgccatcagcgtgctccgcttccagttcgctcccgacctggattttcccgtgccagaagaatacatg

SEQ ID NO: 410 - DNA, 1434 bp, Adiantum aethiopicum
atgcaggcagctgcagctgtgaaggggcaggagcttcccgtggtagacctgatagacaaatacatgcaagtgcaggctcacgactggcataaccggattagaggcgccatcttagggctgatatccttagtgccggttgtcggtagaggggtcagcaagcttgtcggcctcttttggccaaccaccaaggtagacatttgggaggccctcaagatggagcaatatatccggaacattgtccagcaggagatttttgaatttgaaatgcgtctgcttcagtccgacatcgcagcgctggaaacaactgttgggagatacgatagggctacgtctcttattgagaagggcaattttttgagtatctggatcacacaagctgatgcattatattttcgtatgcgagactctaccaacaacatccaccttctccttcacattgtcaccgtgtctacgcttcacatcgcagccctacatgagcgattgacatttggcgaggaactctatggtacaaacaatgcggcaaattggacgcgagatcttgtggataagttcagactgtacacagttgatttgctcccaagcatttttcggaggtggaaggtatggagggaagcccagattgagattagagcatggatagactggggctcctgtggcaatctttcttgtagaccaaatgtttctcatgcaaccgtacgcgacaaagtctcaggggtggtattggcattccgggcacaaaaccgagcttcgacaacaatattctcaggcctttgtgaaggtcacaaaactcggatgcagaacgaggctgttgccgacatggccagctgcctttcacccacgtttgcttttcacaagctcctacccgacaacattcaggcgcagttttctgcattcgacagggagcagttcgggcaggttttcagaggtccatattcgcaggatctttcgtatgaagcattgacgatgaatgttctgaaatccttcataacgagtccgacgaccttcgatcacacagtgggcagagttttggaggtgaacataagatcagggcaccatgtcgatgctatacggttttggtacggccatttggattcaaattctatgactccaggaatcatgggtggaaactctgggggagggactagccatcaggttgatgtgaggggtcgcctcatacaggatttgcgcatggagttctctcacgacatacttgctgcattgcaactgcatttccaagatggcacatttacacggaaatttggcaacgagcttggctgggcatctcgagtattaacttgtactgctccttatggttacaggctcagctcatgggctttccgccaagatgaaggcccctaccgaacggccgccatcagcgtgctccgcttccagttcactcccgagctggattttcccgtgccagaagaatacatg

SEQ ID NO: 411 - DNA, 1281 bp, Tectaria cicutaria
atgcaaattgaggctcatgactggcataaccggggctcatatccgcaataccaaagaaacatcgtcaagcaggagattttcgaacaagaaatgcgccaacatcactccgaaatcgaggctttggaagccgccattgcgagatacgatacggccgcgattactgagaagggcaattttttaagcatctggatctggcaagctgacagactgagtattagtttacggaactctaccaacaacatccaccttctccttcacattgtcaccgtggctgtgcttcatatggccgccatgcatgagcgactaacatttggcgaggaactctacggcacgaacaatacagcagattggagtagagatcttgtgagtgtgttcaagatgtacacaatcaatctaatcccaaggctcttcagggagtggaggcaatggagggaaagccagattgagattaaagaatgggcagtaaggggtgcatggggcaatcttgttcaacgaccggacgttcctcatgcaacggtagaggataagatctcaggggagatgttcacgtttcaggaacagcgtctacactcaacaacagttttctcagctgtttgtcaagatcacaaaactcggatgtcaaacgaggccgttgcagacatggccagctgcatgtcacccacgtttgcttttcacatgctcctacccaaggacagccaagcgcggttctctccgtataatagggagctgttcgaccgcgttttccgaggcccatattcagaggatctcttgcggccacgctccacgtcgggcagagtcttcagatcgcgtgcaactctctttgatcgatcggatcgcgacagaatcttgcaggtgatcgtacgagcggggagccatgttgatgcgatacagtttatatacgaccatatggacccaaatagtgtgactgcagggactatggccagcaacccaaacggggggagtaggcatcaagttgatgtgaggaatcgacgcatacaagatttgcgccttgagtttgctcgaggtgtgcttgcttcggtgcagcttcatttcgacgatggtacatcgacacggaaattgggcgatgaatggggctttgctgctcatacagcaacttgttcaaccccccctggttacaagctcaggtcatgggcctttcgtgaagatcccggcccctacagctcgaccgccatcagtgtactccgcttcgaattcaacccggtggaggaggacccccgtcctagtctagacttgtccatcttctggattggccaacttaat

SEQ ID NO: 412 - DNA, 1242 bp, Tectaria cicutaria
atgcaaattgaggctcatgactggcataaccggggctcatatccgcaataccaaagaaacatcgtcaagcaggagattttcgaacaagaaatgtgccaacatcactccgaaatcgaggctttggaagccgccattgcgagatacgatacggccgcgattactgagaagggcaattttttaagcatctggatctggcaagctgacagactgagtattagtttacggaactctaccaacaacatccaccttctccttcacattgtcaccgtggctgtgcttcatatggcagccatgcatgagcgactaacatttggcgaggaactctacggcacgaacaatacagcagattggagtagagatcttgtgagtgtgttcaagatgtacacaatcaatctaatcccaaggctcttcagggagtggaggcaatggagggaaagccagattgagattaaagaatgggcagtaaggggtgcatggggcaatcttgttcaacgaccggacgtttctcatgcaacggtagaggataagatctcaggggagatgttcacgtttcaggaacagcgtctacactcaacaacagttttctcagctgtttgtcaagatcacaaaactcggatgtcaaacgaggccgttgcagacatggccagctgcatgtcacccacgtttgcttttcacatgctcctacccaaggacagccaagcgcggttctctccgtataatagggagctgttcgaccgcgttttccgaggcccatattcagaggatctcttgcggccacgctccacgtcgggcagagtcttcagatcgcgtgcaactctctttgatcgatcggatcgcgacagaatcttgcaggtgatcgtacgagcggggagccatgttgatgcgatacagtttatatacgaccatatggacccaaatagtgtgactgcagggactatggccagcaacccaaacggggggagtaggcatcaagttgatgtgaggaatcgacgcatacaagatttgcgccttgagtttgctcgaggtgtgcttgcttcggtgcagcttcatttcgacgatggtacatcgacacggaaattgggcgatgaatggggctttgctgctcatacagcaacttgttcaaccccccctggttacaagctcaggtcatgggcctttcgtgaagatcccggcccctacagctcgaccgccatcagtgtactccgcttcgaattcaacccggtggaggaggatcccccgtcc

SEQ ID NO: 413 - DNA, 1242 bp, Tectaria cicutaria
atgcaaattgaggctcatgactggcataaccggggctcatatccgcaataccaaagaaacatcgtcaagcaggagattttcgaacaagaaatgcgccaacatcactccgaaatcgaggctttggaagccgccattgcgagatacgatacggccgcgattactgagaagggcaattttttaagcatctggatctggcaagctgacagactgagtattagtttacggaactctaccaacaacatccaccttctccttcacattgtcaccgtggctgtgcttcatatggccgccatgcatgagcgactaacatttggcgaggaactctacggcacgaacaatacagcagattggagtagagatcttgtgagtgtgttcaagatgtacacaatcaatctaatcccaaggctcttcagggagtggaggcaatggagggaaagccagattgagattaaagaatgggcagtaaggggtgcatggggcaatcttgttcaacgaccggacgtttctcatgcaacggtagaggataagatctcaggggagatgttcacgtttcaggaacagcgtctacactcaacaacagttttctcagctgtttgtcaagatcacaaaactcggatgtcaaacgaggccgttgcagacatggccagctgcatgtcacccacgtttgcttttcacatgctcctacccaaggacagccaagcgcggttctctccgtataatagggagctgttcgaccgcgttttccgaggcccatattcagaggatctcttgcggccacgctccacgtcgggcagagtcttcagatcgcgtgcaactctctttgatcgatcggatcgcgacagaatcttgcaggtgatcgtacgagcggggagccatgttgatgcgatacagtttatatacgaccatatggacccaaatagtgtgactgcagggactatggccagcaacccaaacggggggagtaggcatcaagttgatgtgaggaatcgacgcatacaagatttgcgccttgagtttgctcgaggtgtgcttgcttcggtgcagcttcatttcgacgatggtacatcgacacggaaattgggcgatgaatggggctttgctgctcatacagcaacttgttcaaccccccctggttacaagctcaggtcatgggcctttcgtgaagatcccggcccctacagctcgaccgccatcagtgtactccgcttcgaattcaacccggtggaggaggatcccccgtcc

SEQ ID NO: 414 - DNA, 1488 bp, Dryopteris hondoensis
atggcagcgcccggcattaaggacgacgttaatcctgcttctgtgattgctccgactgctgaggaggtgcagcacgatgaattggtaattatgaaagcgcaacagaacgacgtagatctgctttccaaaaacaatttgcaaatcgaggctcatgactggcataaccgagctagaagcgctatactgatgctcatatccgtaatccccacggtgggtgctgccataagcttcgtcgtcggcctcttttggccagtaaaccaggtggacatttgggaggccatcgaaggcgctgttaggaacattgtccagcaggagatttttgcattcgaattgcagcaactcgagtccgacatccaggggctgcaaaccgttgtccgcagatacgatagagctggtgggcttactgagaggggcaattttctaagcaactggatcacgcaagctgacaatttgtctattcggttgcgaaactctcccaacaacatccaccttctccttcacattgtcaccgtggctgtgcttcatgtcgcagccctgcacgagcgactgacatttggcgaggaactctacggcataaaccatacagcaagttggaagcaagatcttgtggataaaatcaaattgtacacatctgatgtagtcccaaatatcttcaacaagtggaagccgtggagggaagaccagattgagattacagaatggggaagaaatgcccaacatggcaatctcaattatcgcccagcctcttctcatgctagagtggaggataagatctcaggggagataatcacgtttcaggtaaccggccaaaactcaacaacaattttctcaggagtttgccaagatcacaaaactcggatggtgaacgaggccactgcggacatggccagctgcatgtcacccacttttgtgtttcacaagctcctacctcacgatgttcaggcgcagctctctccttatgatgaggtgttcaggcgggttttcagaggcccatattcccaggatcttttgcgccaatccttcacgtctctcaaatccttcagatcgcatccaactcgctttgatcagacagctcgcgacagaatcttggaggtgatcataagagcggggagccttgttgatgctatacaattttggtacgataatgtgtggaatccaaatactatgactgcagggactatggcgggaaatcctagtgggggggccagccataggtttgatttgaggggtcggtccatacaggattttcacatgacgttcgctaatgacgtgcttacttcgttgcgacttcgtttcggagatggtacatcaacacagacattcggcactgaaggttggccggcatctaatacagcaacttgtacagccccctatggctacaggctcagctcatgggcctttcgtgaagatctcggcccctttaactcaaccgccatcagtttactccgcttccaattcacccccgagctcgacgatattcctttgcca

SEQ ID NO: 415 - DNA, 1479 bp, Dryopteris hondoensis
atggcagcgcccggcattaaggacgacgttaatcctgcttctgtgattgctccgactgctgaggaggatgaattggtaattatgaaagcgcaacagaacgacgtagatctgctttccaaaaacaatttgcaaatcgaggctcatgactggcataaccgagctagaagcgctatactgatgctcatatccgtaatccccacggtgggtgctgccataagcttcgtcgtcggcctcttttggccagtaaaccaggtggacatttgggaggccatcgaaggcgctgttaggaacattgtccagcaggagatttttgcattcgaattgcagcaactcgagtccgacatccaggggctgcaaaccgttgtccgcagatacgatagagctggtgggcttactgagaggggcaattttctaagcaactggatcacgcaagctgacaatttgtctattcggttgcgaaactctcccaacaacatccaccttctccttcacattgtcaccgtggctgtgcttcatgtcgcagccctgcacgagcgactgacatttggcgaggaactctacggcataaaccatacagcaagttggaagcaagatcttgtggataaaatcaaattgtacacatctgatgtagtcccaaatatcttcaacaagtggaagccgtggagggaagaccagattgagattacagaatggggaagaaatgcccaacatggcaatctcaattatcgcccagcctcttctcatgctagagtggaggataagatctcaggggagataatcacgtttcaggtaaccggccaaaactcaacaacaattttctcaggagtttgccaagatcacaaaactcggatggtgaacgaggccactgcggacatggccagctgcatgtcacccacttttgtgtttcacaagctcctacctcacgatgttcaggcgcagctctctccttatgatgaggtgttcaggcgggttttcagaggcccatattcccaggatcttttgcgccaatccttcacgtctctcaaatccttcagatcgcatccaactcgctttgatcagacagctcgcgacagaatcttggaggtgatcataagagcggggagccttgttgatgctatacaattttggtacgataatgtgtggaatccaaatactatgactgcagggactatggcgggaaatcctagtgggggggccagccataggtttgatttgaggggtcggtccatacaggattttcacatgacgttcgctaatgacgtgcttacttcgttgcgacttcgtttcggagatggtacatcaacacagacattcggcactgaaggttggccggcatctaatacagcaacttgtacagccccctatggctacaggctcagctcatgggcctttcgtgaagatctcggcccctttaactcaaccgccatcagtttactccgcttccaattcacccccgagctcgacgatattcctttgcca

SEQ ID NO: 416 - protein, 452 aa, Asplenium pellucidum
MQVEVHDWNNRLRKAVLALTSEIPMVGFAISGLIGLFWPKNKVSIWEALKVEQYVRNIVQQELFEFEMGLLESDIEALQTTIHRYDQAAATLEKGNFLSIWISQADGLLIRMRRSTNNIHLLLHIVTVAVLHMAALHERLTFGEELYGSNNTANWKQALVQMFEEYTVNLIPTVFKEWRQWRDSQIEIKQWAKRGQWGTVVSSPDSSHATVEDKLAGELFTFSRSYLYSTTIFSGVTGDQKTRMMNEATADMASCMSPTFAFHELLPDDVKKQFSPYNKELFGRVFRGPYSQDLMQPLFTNINKDFRSHPKRFDQTARDRVLEVTIRAGHHIDAIQFWYDHTNANSTTAGLMAGNSSGGSRHQIDVRDRPIEELRMEFAHDTLASLQLHFRDGTATKRYGNELGWASKIATCTAPFGYKLSSWAFREDPGFYNTTAISVLRFDFTPEDPSAY

SEQ ID NO: 417 - protein, 452 aa, Asplenium laserpitiifolium
MQVEVHDWNNRLRKAVLALTSEIPTVGFAISGLIGLFWPKNKVSIWEALKVEQYVRNIVQQELFEFEMGLLESDIEALQTTIHRYDQAAATLEKGNFLSIWISQADGLLIRMRRSTNNIHLLLHIVTVAVLHMAALHERLTFGEELYGSNNTANWKQALVQMFEEYTVNLIPTVFKEWRQWRDSQIEIKQWAKRGQWGTVVSSPDSSHATVEDKLAGELFTFSRSYLYSTTIFSGVTGDQKTRMMNEATADMASCMSPTFAFHELLPDDVKKQFSPYNKELFGRVFRGPYSQDLMQPLFTNINKDFRSHPKRFDQTARDRVLEVTIRAGHHIDAIQFWYDHTNANSTTAGLMAGNSSGGSRHQIDVRDRPIEELRMEFAHDTLASLQLHFRDGTATKRYGNELGWASKIATCTAPFGYKLSSWAFREDPGFYNTTAISVLRFDFTPEDPSAY

SEQ ID NO: 418 - protein, 529 aa, Asplenium laserpitiifolium
MDSDTIAQPRELNTASVGASAAEKVQQDQLDVVATPEMQGDSDVDPQFEQESINLSALIAAGAVEGHDDVDLFAKYMEVEAHDWINRLREAILGLTAFIPNVVVGLAINGFIRLLWPPNKVSIWEAINAEQHVRNIVQRELMEFEMRTLQSSIEALETTIHRYDQAASTTEKGNFLSSWITQADILFSRMRNSPNRIHLQLHIVTVAALHMAALHERLTFGEELYGLDDTAAWKRALVDMFEEYTVKLIPTVFKEWRPWRESQIEISEWRRRGQSGNLIFRPDVSSATVEDKLSGELFTFRVNYQYSTTVFSGVTRDHRTRMMNEAVADMDSCISPTFALHKLLPDDVKIRFSPYDRQVFGRVSRGPYSQDLRQQQFTRVKDFRSHPRRFDQTARDRVLQVNIRAQNHVHALQFLYDHANPNSTTAGIIAGSFTSGGTTNRINVRTRPIQKLRMEFAQDVLASLQLHFQDGTSTQKFGNINGWASTIATCTAPNGYKLSSWAFHEDPGPNGTPAINVLRFDFTPEDPSS

SEQ ID NO: 419 - protein, 529 aa, Asplenium laserpitiifolium
MDSDTIAQPRELNTASVGASAAEKVQQDQLDVVATPEMQGDSDVDPQFEQESINLSALIAAGAVEGHDDVDLFAKYMEVEAHDWINRLREAILGLTAFIPNVVVGLAINGFIRLLWPPNKVSIWEAINAEQHVRNIVQRELMEFEMRTLQSSIEALETTIHRYDQAASTTEKGNFLSSWITQADILFSRMRNSPNRIHLQLHIVTVAALHMAALHERLTFGEELYGLDDTAAWKRALVDMFEEYTVKLIPTVFKEWRPWRESQIEISEWRRRGQSGNLIFRPDVSSATVEDKLSGELFTFRVNYQYSTTVFSGVTRDHRTRMMNEAVADMDSCISPTFALHKLLPDDVKIQFSPYDRQVFGRVSRGPYSQDLRQQQFTRVKDFRSHPRRFDQTARDRVLQVNIRAQNHVHALQFLYDHANPNSTTAGIIAGSFTSGGTTNRINVRTRPIQKLRMEFAQDVLASLQLHFQDGTSTQKFGNINGWASTIATCTAPNGYKLSSWAFREDPGPNGTPAISVLRFDFTPEDPSS

SEQ ID NO: 420 - protein, 415 aa, Asplenium laserpitiifolium
MDSDTIAQPRELNTASVGASAAEKVQQDQLDVVATPEMQGDSDVDPQFEQESINLSALIAAGAVEGHDDVDLFAKYMEVEAHDWINRLREAILGLTAFIPNVVVGLAINGFIRLLWPPNKVSIWEAINAEQHVRNIVQRELMEFEMRTLQSSIEALETTIHRYDQAASTTEKGNFLSSWITQADILFSRMRNSPNRIHLQLHIVTVAALHMAALHERLTFGEELYGLDDTAAWKRALVDMFEEYTVKLIPTVFKEWRPWRESQIEISEWRRRGQSGNLIFRPDVSSATVEDKLSGELFTFRVNYQYSTTVFSGVTRDHRTRMMNEAVADMDSCISPTFALHKLLPDDVKIRFSPYDRQVFGRVSRGPYSQDLRQQQFTRVKDFRSHPRRFDQTARDRVLQALLPGVLRRGGLRIG

SEQ ID NO: 421 - protein, 503 aa, Hymenasplenium unilaterale
MAAAPGMKDSEMIADVVTTTVSVPAGGEVPLDLDELGRTAVTNNNIDVLAKYMQMEAHDWHNRVRDAVLGLIGAVSVVGYAVSKLIGLFWPANKVDIWEALKLEEYVKNIVKREIFEFEMQQLESEVEALELTISRYDKAALREKGNFLSIWISRADRLIILLRNSTNNIHLLLHIVTVSVLHMAAMHERLTFGEELYGTNNTENWTKDLVQVYEMYTSHIIPDIFKKWSEWRETQIEIKAWAVKEKWGNNSSRPAVSHATVEDKISGEKIEFRRSGIYSTTIFLDAAQDHKTRMLNEAIADMNSCLSPTFDFHKLLPNNIRTRFLPYDKELFGQVFRGPYSQDLLQSLFTDVKSFRTRPTHFDQIAHDKILEVTIGEGHHVHALQFLYDQQENPEPMTAGSMVTNSTGGSRHQVDLRNRHIHDLRLEFSQDVLASLQLRFEDGTSTQKFGNELGWATNIVTCTTPSGYRLSSWAFREDPGPYNTTAISVIRFQFTPNEDPLS

SEQ ID NO: 422 - protein, 505 aa, Pellaea ovata
MATEDVNAVAPPAEEVQAAMGAEEDPVFSQLAQKMVAAVAEGQDVPVDLLAQYMQVEAHDWHNRIRGAILGLLSAVPKVGTAISMLIGLFWPANRVDIWEAINAEEYIRNIVQQEIFEFELQLLRGDIQALETTVARYDTAALTEKGNFLSIWISQADALYIRMRNSANNIHLLLHIVTVSTLHLAALHERLTFGEELYGSNNTANWTQDLVDKFEVYTTDLIPNIFKRWKDWRETQIEITAWVRRGSCGNLTCRPNVSFATVEDKISGARFSFQATNRNSTTIFSGICEDHKTRMVNEAIADMASCLSPTFAFHKLLPKDIQTRFSPYDREQFGRVFRGPYSQDLSHGAWTALKAFRSHPTRFDQTTRDRILEVIIRAGHHVDAIQFWYDHVNPNAVTAGTMAGNPMGGNRHQIDVRNRPIHELRMEFAHDILASLQLHFEDGTSTRRLGNTPGWASRIATCTAPYGYRFSSWAFREDPGPYGTTAISVLRFQFTPELEMPLPA

SEQ ID NO: 423 - protein, 505 aa, Pellaea ovata
MATEDVNAVAPPAEEVQAAMGAEEDPVFSQLAQKMAAAVAEGQDVPVDLLAQYMQVEAHDWHNRIRGAILGLISAVPKVGTAISMLIGLFWPANKVDIWEALNAEEYIRNIVQQEIFEFELQLLRNDIEALETTVARYDMAALTEKGNFLSIWISQADALYIRMRNSANNIHLLLHIVTVSTLHLAALHERLTFGEELYGSNNTANWTQELVDKFEVYTTDLIPNIFKRWKDWRETQIEIRAWVHRGSCGNLMCRPDVSFATVEDKISGALFSFQASNRNSTTIFSGICEDHKTRMVNEAIADMASCLSPTFAFHKLLPEDIQTRFSPYDREQFGRVFRGPYSQDLSHGAWTVLKAFRSHPTRFDHPTRDRILEVIIRAGHHVDAIQFWYDHVNPNAVTAGTIAGNSMGGNRHQIDVRNRPIHELRMEFSHDILASLQLHFENGTSTQRFGNELGWASRIATCTAPYGYRFSSWAFREDPGPYGTTAISVLRFQFTPELEMPLPA

SEQ ID NO: 424 - protein, 503 aa, Pellaea ovata
MATEDVNAVAPPAEEAAMGAEEDPVFSQLAQKMAAAVAEGQDVPVDLLAQYMQVEAHDWHNRIRGAILGLISAVPKVGTAISMLIGLFWPANKVDIWEALNAEEYIRNIVQQEIFEFELQLLRNDIEALETTVARYDMAALTEKGNFLSIWISQADALYIRMRNSANNIHLLLHIVTVSTLHLAALHERLTFGEELYGSNNTANWTQELVDKFEVYTTDLIPNIFKRWKDWRETQIEIRAWVHRGSCGNLMCRPDVSFATVEDKISGALFSFQASNRNSTTIFSGICEDHKTRMVNEAIADMASCLSPTFAFHKLLPEDIQTRFSPYDREQFGRVFRGPYSQDLSHGAWTVLKAFRSHPTRFDHPTRDRILEVIIRAGHHVDAIQFWYDHVNPNAVTAGTIAGNSMGGNRHQIDVRNRPIHELRMEFSHDILASLQLHFENGTSTQRFGNELGWASRIATCTAPYGYRFSSWAFREDPGPYGTTAISVLRFQFTPELEMPLPA

SEQ ID NO: 425 - protein, 503 aa, Pellaea ovata
MATEDVNAVAPPAEEAAMGAEEDPVFSQLAQKMAAAVAEGQDVPVDLLAQYMQVEAHDWHNRIRGAILGLISAVPKVGTAISMLIGLFWPANKVDIWEALNAEEYIRNIVQQEIFEFELQLLRNDIEALETTVARYDMAALTEKGNFLSIWISQADALYIRMRNSANNIHLLLHIVTVSTLHLAALHERLTFGEELYGSNNTANWTQELVDKFEVYTTDLIPNIFKRWKDWRETQIEIRAWVHRGSCGNLMCRPDVSFATVEDKISGALFSFQASNRNSTTIFSGICEDHKTRMVNEAIADMAGCLSPTFAFHKLLPEDIQTRFSPYDREQFGRVFRGPYSQDLSHGAWTVLKAFRSHPTRFDHPTRDRILEVIIRAGHHVDAIQFWYDHVNPNAVTAGTIAGNSMGGNRHQIDVRNRPIHELRMEFSHDILASLQLHFENGTSTQRFGNELGWASRIATCTAPYGYRFSSWAFREDPGPYGTTAISVLRFQFTPELEMPLPA

SEQ ID NO: 426 - protein, 505 aa, Pellaea ovata
MATEDVNAVAPPAEEVQAAMGAEEDPVFSQLAQKMVAAVAEGQDVPVDLLAQYMQVEAHDWHNRIRGAILGLISAVPKVGTAISMLIGLFWPANKVDIWEALNAEEYIRNIVQQEIFEFELQLLRNDIEALETTVARYDMAALTEKGNFLSIWISQADALYIRMRNSANNIHLLLHIVTVSTLHLAALHERLTFGEELYGSNNTANWTQELVDKFEVYTTDLIPNIFKRWKDWRETQIEIRAWVHRGSCGNLMCRPDVSFATVEDKISGALFSFQASNRNSTTIFSGICEDHKTRMVNEAIADMASCLSPTFAFHKLLPEDIQTRFSPYDREQFGRVFRGPYSQDLSHGAWTVLKAFRSHPTRFDHPTRDRILEVIIRAGHHVDAIQFWYDHVNPNAVTAGTIAGNSMGGNRHQIDVRNRPIHELRMEFSHDILASLQLHFENGTSTQRFGNELGWASRIATCTAPYGYRFSSWAFREDPGPYGTTAISVLRFQFTPELEMPLPA

SEQ ID NO: 427 - protein, 505 aa, Pellaea ovata
MATEDVNAVAPPAEEVQAAMGAEEDPVFSQLAQKMVAAVAEGQDVPVDLLAQYMQVEAHDWHNRIRGAILGLISAVPKVGTAISMLIGLFWPANKVDIWEALNAEEYIRNIVQQEIFEFELQLLRNDIEALETTVARYDMAALTEKGNFLSIWISQADALYIRMRNSANNIHLLLHIVTVSTLHLAALHERLTFGEELYGSNNTANWTQELVDKFEVYTTDLIPNIFKRWKDWRETQIEIRAWVHRGSCGNLMCRPDVSFATVEDKISGALFSFQASNRNSTTIFSGICEDHKTRMVNEAIADMASCLSPTFAFHKLLPEDIQTRFSPYDREQFGRVFRGPYSQDLSHGAWTALKAFRSHLTRFDQTTRDRILEVIIRAGHHVDAIQFWYDHVNPNAVTAGTMAGNPMGGNRHQIDVRNRPIHELRMEFAHDILASLQLHFEDGTSTRRLGNTPGWASRIATCTAPYGYRFSSWAFREDPGPYGTTAISVLRFQFTPELEMPLPA

SEQ ID NO: 428 - protein, 503 aa, Pellaea ovata
MATEDVNAVAPPAEEAAMGAEEDPVFSQLAQKMAAAVAEGQDVPVDLLAQYMQVEAHDWHNRIRGAILGLISAVPKVGTAISMLIGLFWPANKVDIWEALNAEEYIRNIVQQEIFEFELQLLRNDIEALETTVARYDMAALTEKGNFLSIWISQADALYIRMRNSANNIHLLLHIVTVSTLHLAALHERLTFGEELYGSNNTANWTQDLVDKFEVYTTDLIPNIFKRWKDWRETQIEIRAWVQRGSCGNLMCRPDVSFATVEDKISGALFSFQATNRNSTTIFSGICQDHKTRMVNEAIADMASCLSPTFAFHKLLPEDIQTRFSPYDREQFGRVFRGPYSQDLSHGAWTVLKAFRSHPTRFDQTTRDRILEVIIRAGHHVDAIQFWYDHVNPNAVTAGTMAGNSMGGNRHQIDVRNRPIHELRMEFSHDILASLQLHFEDGTSTRRFGNELGWASRIATCTAPFGYRFSSWAFREDPGPYGTTAISVLRFQFTPELEMPLPA

SEQ ID NO: 429 - protein, 505 aa, Pellaea ovata
MATEDVNAVAPPAEEVQAAMGAEEDPVFSQLAQKMVAAVAEGQDVPVDLLAQYMQVEAHDWHNRIRGAILGLLSAVPKVGTAISMLIGLFWPANRVDIWEAINAEEYIRNIVQQEIFEFELQLLRSDIQALETTVARYDSAALTEKGNFLSIWISQADALYIRMRNSANNIHLLLHIVTVSTLHLAALHERLTFGEELYGSNNTANWTQDLVDKFEVYTTDLIPNIFKRWKDWRETQIEITAWVRRGSCGNLTCRPNVSFATVEDKISGARFSFQATNRNSTTIFSGICEDHKTRMVNEAIADMASCLSPTFAFHKLLPKDIQTRFSPYDREQFGRVFRGPYSQDLSHGAWTALKAFRSHPTRFDQTTRDRILEVIIRAGHHVDAIQFWYDHVNPNAVTAGTMAGNPMGGNRHQIDVRNRPIHELRMEFAHDILASLQLHFEDGTSTRRLGNTPGWASRIATCTAPYGYRFSSWAFREDPGPYGTTAISVLRFQFTPELEMPLPA

SEQ ID NO: 430 - protein, 505 aa, Pellaea ovata
MATEDVNAVAPPAEEVQAAMGAEEDPVFSQLAQKMVAAVAKGQDVPVDLLAQYMQVEAHDWHNRIRGAILGLLSAVPKVGTAISMLIGLFWPANRVDIWEAINAEEYIRNIVQQEIFEFELQLLRGDIQALETTVARYDTAALTEKGNFLSIWISQADALYIRMRNSANNIHLLLHIVTVSTLHLAALHERLTFGEELYGSNNTANWTQDLVDKFEVYTTDLIPNIFKRWKDWRETQIEITAWVRRGSCGNLTCRPNVSFATVEDKISGARFSFQATNRNSTTIFSGICEDHKTRMVNEAIADMASCLSPTFAFHKLLPKDIQTRFSPYDREQFGRVFRGPYSQDLSHGAWTALKAFRSHPTRFDQTTRDRILEVIIRAGHHVDAIQFWYDHVNPNAVTAGTMAGNPMGGNRHQIDARNRPIHELRMEFAHDILASLQLHFEDGTSTRRLGNTPGWASRIATCTAPYGYRFSSWAFREDPGPYGTTAISVLRFQFTPELEMPLPA

SEQ ID NO: 431 - protein, 503 aa, Pellaea ovata
MATEDVNAVAPPAEEAAMGAEEDPVFSQLAQKMAAAVAEGQDVPVDLLAQYMQVEAHDWHNRIRGAILGLISAVPKVGTAISMLIGLFWPANRVDIWEAINAEEYIRNIVQQEIFEFELQLLRSDIQALETTVARYDTAALTEKGNFLSIWISQADALYIRMRNSANNIHLLLHIVTVSTLHLAALHERLTFGEELYGSNNTANWTQDLVDKFEVYTTDLIPNIFKRWKDWRETQIEIRAWVQRGSCGNLMCRPDVSFATVEDKISGALFSFQATNRNSTTIFSGICQDHKTRMVNEAIADMASCLSPTFAFHKLLPEDIQTRFSPYDREQFGRVFRGPYSQDLSHGAWTVLKAFRSHPTRFDQTTRDRILEVIIRAGHHVDAIQFWYDHVNPNAVTAGTMAGNSMGGNRHQIDVRNRPIHELRMEFSHDILASLQLHFEDGTSTRRFGNELGWASRIATCTAPFGYRFSSWAFREDPGPYGTTAISVLRFQFTPELEMPLPA

SEQ ID NO: 432 - protein, 507 aa, Myriopteris myriophylla
MKDSEMKAAEDVNTVSVLAPPAEKLRQDDELVMTAPVAEEGQEVPVDQFAKYMQIEAHDWHNRIREAILGLISAVPKVGAAVSKLVSIFWPANKVDIWEALNAEQYVRNIVLQELFEFEMLQLRSDIEALQTTVGRYDTAAITEKGNFLSIWITQADSLYIRLRNSTNNIHLLLHIVTVVVLHVAALHERLTFGEELYGTNNTENWTKDLVDVFEKYTSHLIPNLFKQWKPWRESQIEIKAWAVRGSWGNLTQRPDVSHATVEDKISGENFTFRLSGRYSTTVFSGVCEDHKTRMGNEAIADMASCLSPTFAFHKLLPDDIQAQFSPYDKALFGQVFRGPYSQDLLQTYSTGQTSFRSSPIRFDQTTRDRILEVTIRAGHHVDAIQFWYDHVDSNAMTAGTMAGNSTGGSSHQVNVRDQPIQELRMEFSHRVLASLQLHFEDGTSTRKFGNELGWASNIVTCTAPIGYRLSSWAFREDAGPYGTLGISLLRFQFTPEDISTQAAMIS

SEQ ID NO: 433 - protein, 507 aa, Myriopteris myriophylla
MKDSEMKAAEDVHTVSVLAPPAEKLRQDDELVMTAPVAEEGQEVPVDQFAKYMQIEAHDWHNRIREAILGLISAVPKVGAAVSKLVSIFWPANKVDIWEALNAEQYVRNIVLQELFEFEMLQLRSDIEALQTTVGRYDTAAITEKGNFLSIWITQADSLYIRLRNSTNNIHLLLHIVTVAVLHVAALHERLTFGEELYGTNNTENWTKDLVDVFEKYTSHLIPNLFKQWKPWRESQIEIKAWAVRGSWGNLTQRPDVSHATVEDKISGENFTFRLSGRYSTTVFSGVCEDHKTRMGNEAIADMASCLSPTFAFHKLLPDDIQAQFSPYDKALFGQVFRGPYSQDLLQTYSTGQTSFRSSPIRFDQTTRDRILEVTIRAGHHVDAIQFWYDHVDSNAMTAGTMAGNSTGGSSHQVNVRDQPIQELRMEFSHRVLASLQLHFEDGTSTRKFGNELGWASNIVTCTAPIGYRLSSWAFREDAGPYGTLGISLLRFQFTPEDISTQAAMIS

SEQ ID NO: 434 - protein, 507 aa, Myriopteris myriophylla
MKDSEMKAAEDVNTVSVLAPPAEKLRQDDELVMTAPVAEEGQEVPVDQFAKYMQIEAHDWHNRIREAILGLISAVPKVGAAVSKLVSIFWPANKVDIWEALNAEQYVRNIVLQELFEFEMLQLRSDIEALQTTVGRYDTAAITEKGNFLSIWITQADSLYIRLRNSTNNIHLLLHIVTVVVLHVAALHERLTFGEELYGTNNTENWTKDLVDVFEKYTSHLIPNLFKQWKPWRESQIEIKAWAVRGSWGNLTQRPDVSHATVEDKISGENFTFRLSGRYSTTVFSGVCEDHKTRMGNEAIADMASCLSPTFAFHKLLPDDIQAQFSPYDKALFGQVFRGPYSQDLLQTYSTGQTSFRSSPIRFDQTTRDRILEVTIRAGHHVDAIQFWYDHVDSNAMTAGTMAGNSTGGSSHQVNVRDQPIQELRMEFSHRVLASLQLHFEDGTSTRKFGNELGWASNIVTCTAPIGYRLSSWAFREDAGPYGTLGISLLRFQFTPEDISNQAAMIS

SEQ ID NO: 435 - protein, 507 aa, Myriopteris myriophylla
MKDSEMKAAEDVNTVSVLAPPAEKLRQDDELVMTAPVAEEGQEVPVDQFAKYMQIEAHDWHNRIREAILGLISAVPKVGAAVSKLVSIFWPANKVDIWEALNAEQYVRNIVLQELFEFEMLQLRSDIEALQTTVGRYDTAAITEKGNFLSIWITQADSLYIRLRNSTNNIHLLLHIVTVVVLHVAALHERLTFGEELYGTNNTENWTKDLVDVFEKYTSHLIPNLFKQWKPWRESQIEIKAWAVRGSWGNLTQRPDVSHATVEDKISGENFTFRLSGRYSTTVFSGVCEDHKTRMGNEAIADMASCLSPTFAFHKLLPDDIQEQFSPYDKALFGQVFRGPYSQDLLQTYSTGQTSFRSSPIRFDQTTRDRILEVTIRAGHHVDAIQFWYDHVDSNAMTAGTMAGNSTGGSSHQVNVRDQPIQELRMEFSHRVLASLQLHFEDGTSTRKFGNELGWASNIVTCTAPIGYRLSSWAFREDAGPYGTLGISLLRFQFTPEDISTQAAMIS

SEQ ID NO: 436 - protein, 514 aa, Pyrrosia linearifolia
MAAEVTTVSELAPAADGKVQNGEMAEEDPIFAQLAQKMVAAAEKGEAPVDLLAQYMQVEAHDWHNRVRGAILGLISMVPKVGAAISRLIGLFWPANRVDIWEALRAEEYIRNIVQEELFEFEMRLLQNDIEALETTVGRYDTAALGEKGNFLSIWISQADALYIRMRNSTNNIHLLLHMVTVSTLHLAALHERLTFGEELYGTDNSANWTRDLVDKFEQYTTDLIPNVFQRWKEWRPTQIQITARRQRGSCGVVTCRPNVSFATVEDKISGAIFSFQATNHYSLTIFSEVCEDHKTRMVNEAVADMASCLSPTFAFHKLLPDNIQGQFSPYDRRQFGQVFRGPYSQDLSHGLWTVFKSFRSRTTRSDQTLRDRIVQVIIRAGSHVDAIQFVYDHANPNSTTPGIMAGNAAGGIRHQVDVRNRPIQEVRMEFARDVLASVQLHFEDGTSSQKFGNELFGTWATRVLTCTAPYGYRFSSWAFREDPGPYRTTAISVLRFQFTPELDMPLPASYMIS

SEQ ID NO: 437 - protein, 447 aa, Pyrrosia stigmosa
MAVDVVASDWNNRIRDAVIKISSKIPEVGAAVSILIGFFWPQNKVDVFQALKADLTKLVKKEILDYELNLHQSEINALKKIMERYKAAQTHEKGNFLSNWITEADELSIIFRESTNNIHLILPIITLALLHLIGLRERLDFGKELYQEDNTLQWKEDLEEMYKTYILDFLPDIFRKWKLWRANQVEIKGWTEPHPTAIPPFFRIESHATVVDTVTGERKHFSVDLTDSTSVFARICEDQKTRMCNDATADMAGCISPSFVFHKLLPDNNKNLPKYDKEVFGRMFKGPYSGDLCMSELNFGFGNPIRAFRSRPDHDDYTPDLGPIVKLIIREWNSIDAMQFVYENHQGKLAGNEGGGQRHEIDVTGKAINGLRMGFSNGVLTYVQVSYNEGTASATYGNRSGWRCEEVNAKGPAAYRVSSWSYRADWGPSNSYGPSVVLLEYAPQHME

SEQ ID NO: 438 - protein, 447 aa, Pyrrosia stigmosa
MAVDVVASDWNNRIRDAVIKISSKIPEVGAAVSILIGFFWPQNKVDVFQALKADLTKLVKKEILDYELNLHQSEINALKKIMERYKAAQTHEKGNFLSNWITEADELSIIFRESTNNIHLILPIITLALLHLIGLRERLDFGKELYQEDNTLQWKEDLEEMYKTYILDFLPDIFRKWKLWRANQVEIKGWTEPHPTAIPPFFRIESHATVVDMVTGERKHFSVDLTDSTSVFARICEDQKTRMCNDATADMAGCISPSFVFHKLLPDNNKNLPKYDKEVFGRMFKGPYSGDLCMSELNFGFGNPIRAFRSRPDHDDYTPDLGPIVKLIIREWNSIDAMQFVYENHQGKLAGNEGGGQRHEIDVTGKAINGLRMGFSNGVLTYVQVSYNEGTASATYGNRSGWRCEEVNAKGPAAYRVSSWSYRADWGPSNSYGPSVVLLEYAPQHME

SEQ ID NO: 439 - protein, 503 aa, Polypodium attenuatum
MEEEVGPLHGEEGRGESSSPTDEVGSLDDANIGQELPQNMQVEAHDWHNRMRAAMLALISAIPKVGAVVSSIIGIFWPANMQDIWVALNMEEYVKNIVKQEIFEFEMRQLQSSIQALETSIRRYERAALLEKGSFLSIWISQADKLYFQLRNSANDIHLLLHVVTVSVLHMVAMHERLTFGEELYGSDNSEKWTKDIVEVFQMYTSDFIPSLFKKWKQWREEQIEIRAWVVPGVWGNVSQITPDVSHATVEDKLTGESFRFQATRRNSTTIFLDVCQDHKSRMVNEAVADMASCLSSTFAFRSLLPDRIQEQYPAYDRELFGQVFRGPYSQDLCRRVINEFRTFRTRPTSSDQTALDRVWEVIVVTANFLNTIQFVYFDDNARIPGVVAGNPNTAGRVFVHRIDVLDRPIRDLRLEFSSEALATLQLYFEDGSSTQRMGATFMTSVEERVTCTVPRGYRLSSWAFREDPAISVLRFQFTPEELRPIPAQMIMIPPTRPQPTPP

SEQ ID NO: 440 - protein, 503 aa, Polypodium attenuatum
MEEEVGPLHGEEGRGESSSPTDEVGSLDDANIGQELPQNMQVEAHDWHNRMRAAMLALISAIPKVGAVVSSIIGIFWPANMQDIWVALNMEEYVKNIVKQEIFEFEMRQLQSSIQALETSIRRYERAALLEKGSFLSIWISQADKLYFQLRNSANDIHLLLHVVTVSVLHMAAMHERLTFGEELYGSDNSEKWTKDIVEVFQMYTSDFIPSLFKKWKQWREEQIEIRAWVVPGVWGNVSQITPDVSHATVEDKLTGESFRFQATRRNSTTIFLDVCQDHKSRMVNEAVADMASCLSSTFAFRSLLPDRIQEQYPAYDRELFGQVFRGPYSQDLCRRVINEFRTFRTRPTSSDQTALDRVWEVIVVTANFLNTIQFVYFDDNARIPGVVAGNPNTAGRVFVHRIDVLDRPIRDLRLEFSSEALATLQLYFEDGSSTQRMGATFMTSVEERVTCTVPRGYRLSSWAFREDPAISVLRFQFTPEELRPIPAQMIMIPPTRPQPTPP

SEQ ID NO: 441 - protein, 503 aa, Polypodium attenuatum
MEEEVGPLHGEEGRGESSSPTDEVGSLDDANIGQELPQNMQVEAHDWHNRMRAAMLALISAIPKVGAVVSSIIGIFWPANMQDIWVALNMEEYVKNIVKQEIFEFEMRQLQSSIQALETSIRRYERAALLEKGSFLSIWISQADKLYFQLRNSANDIHLLLHVVTVSVLHMAAMHERLTFGEELYGSDNSEKWTKDIVEVFQMYTSDFIPSLFKKWKQWREEQIEIRAWVVPGVWGNVSQITPDVSHATVEDKLTGESFRFQATRRNSTTIFLDVCQDHKSRMVNEAVADMTSCLSSTFAFRSLLPDRIQEQYPAYDRELFGQVFRGPYSQDLCRRVINEFRTFRTRPTSSDQTALDRVWEVIVVTANFLNTIQFVYFDDNARIPGVVAGNPNTAGRVFVHRIDVLDRPIRDLRLEFSSEALATLQLYFEDGSSTQRMGATFMTSVEERVTCTVPRGYRLSSWAFREDPAISVLRFQFTPEELRPIPAQMIMIPPTRPQPTPP

SEQ ID NO: 442 - protein, 447 aa, Aglaomorpha
MAAGVVASDWNNRIRDAVIKISSKVPEVGTVVSVLIGFFWPQNKVDVFQALKADLTKLVKKEILDYELNLHQSEINALKIVMGRYQAARTHEKGYFLSNWITEADRLSVIFRESTNNIQLILPIITLALLHLIGLRERLDFGKELYQEDNTQQWKEDLEEMYKAYIVDSLPDIFRKWKLWRANQVEIKAWTETHPTAIPPFFRMESHATVVDLITGERKHFSVDLTESKSIFARICEDQKTRMCNDATADMSGCISPSFVFHKLLPDNYKNFPKYDKEVFGRMFRGPYSADLCRSDLNFGFGYPIPIFRTRPDHDDYAPDSGPITKLILREWNSIDAMQFIYANRRGNLAGDERGGQRHEIDVMGKAINGFHMGFSNGVLTHVQVIYNDGTSSSTYGNRSGWRCEEVYAKGPSAYRVSSWSYRVDMGPSESYGPSVVQLEYVPQQLE

SEQ ID NO: 443 - protein, 447 aa, Aglaomorpha
MAAGVVASDWNNRIRDAVIKISSKVPEVGTVVSILVGFFWPQNKIDIFQALKADLTKLVKKEILDYELNLHQSEINALKIVMGRYQAARTHEKGNFLSNWITEADRLSVIFRESTNNIHLILPVITLALLHLIGLRERLDFGKELYQEDNTQQWKEDLEEIYKTYIVDFLPDIFRKWKLWRANQVEIKAWTETHPTAIPPFFRIESHATVVDTITGERKHFSVDLTESKSIFARICEDQKTRMCNDAAADMAGCISPSFVFHKLLPDNNKNFPKYDKEVFGRMFRGPYSADLCKSDLNFGFGNTIPIFRTRPDHDDYAPESGPITKLIIREWNSIDAMQFMYANRQGNLAGDERGGQRHEIDVTGKAINGLRMGFSNGVLTYVQVHYNDGTASSTYGNRSGWRCEEVNPKGPSAYRVSSWSYRVDMGPSESYGPSVVQLEYVPQQLE

SEQ ID NO: 444 - protein, 447 aa, Aglaomorpha
MAAGVVASDWNNRIRDAVIKISSKVPEVGTVVSILVGFFWPQNKIDIFQALKADLTKLVKKEILDYELNLHQSEINALKIVMGRYQAARTHEKGNFLSNWITEADRLSVIFRESTNNIHLILPVIILALLHLIGLRERLDFGKELYQEDNTQQWKEDLEEIYKTYIVDFLPDIFRKWKLWRANQVEIKAWTETHPTAIPPFFRIESHATVVDTITGERKHFSVDLTESKSIFARICEDQKTRMCNDAAADMAGCISPSFVFHKLLPDNNKNFPKYDKEVFGRMFRGPYSADLCKSDLNFGFGNTIPIFRTRPDHDDYAPESGPITKLIIREWNSIDAMQFMYANRQGNLAGDERGGQRHEIDVTGKAINGLRMGFSNGVLTYVQVHYNDGTASSTYGNRSGWRCEEVNPKGPSAYRVSSWSYRVDMGPSESYGPSVVQLEYVPQQLE

SEQ ID NO: 445 - protein, 447 aa, Aglaomorpha
MAAGVVASDWNNRIRDAVIKISSKVPEVGTVVSILVGFFWPQNKVDVFQALKADLTKLVKKEILDYELNLHQSEINALKIVMGRYQAARTHEKGNFLSNWITEADRLSVIFRESTNNIHLILPVITLALLHLIGLRERLDFGKELYQEDNTQQWKEDLEEIYKTYIVDFLPDIFRKWKLWRANQVEIKAWTETHPTAIPPFFRIESHATVVDTITGERKHFSVDLTESKSIFARICEDQKTRMCNDAAADMAGCISPSFVFHKLLPDNNKNFPKYDKEVFGRMFRGPYSADLCKSDLNFGFGNTIPIFRTRPDHDDYAPESGPITKLIIREWNSIDAMQFIYANRRGNLAGDERGGQRHEIDVMDKAINGFHMGFSNGVLTHVQVIYNDGTSSSTYGNRSGWRCEEVYAKGPSAYRVSSWSYRVDMGPSESYGPSVVQLEYVPQQLE

SEQ ID NO: 446 - protein, 447 aa, Aglaomorpha
MAAGVVASDWNNRIRDAVIKISSKVPEVGTVVSILVGFFWPQNKIDIFQARKADLTKLVKKEILDYELNLHQSEINALKIVMGRYQAARTHEKGNFLSNWITEADRLSVIFRESTNNIHLILPVITLALLHLIGLRERLDFGKELYQEDNTQQWKEDLEEIYKTYIVDFLPDIFRKWKLWRANQVEIKAWTETHPTAIPPFFRIESHATVVDTITGERKHFSVDLTESKSIFARICEDQKTRMCNDAAADMAGCISPSFVFHKLLPDNNKNFPKYDKEVFGRMFRGPYSADLCKSDLNFGFGNTIPIFRTRPDHDDYAPESGPITKLIIREWNSIDAMQFMYANRQGNLAGDERGGQRHEIDVTGKAINGLRMGFSNGVLTYVQVHYNDGTASSTYGNRSGWRCEEVNPKGPSAYRVSSWSYRVDMGPSESYGPSVVQLEYVPQQLE

SEQ ID NO: 447 - protein, 457 aa, Aglaomorpha
MAAGVVASDWNNRIRDAVIKISSKVPEVGTVVSILVGFFWPQNKIDIFQALKADLTKLVKKEILDYELNLHQSEINALKIVMGRYQAARTHEKGNFLSNWITEADRLSVIFRESTNNIHLILPVITLALLHLIGLRERLDFGKELYQEDNTQQWKEDLEEIYKTYIVDFLPDIFRKWKLWRANQVEIKAWTETHPTAIPPFFRIESHATVVDTITGERKHFSVDLTESKSIFARICEDQKTRMCNDAAADMAGCISPSFVFHKLLPDNNKNFPKYDKEVFGRMFRGPYSADLCKSDLNFGFGNTIPIFRTRPDHDDYAPESGPITKLIIREWNSIDAMQFMYANRQGNLAGDERGGQRHEIDVTGKAINGLRMGFSNGVLTYVQVHYNDGTASSTYGNRSGWRCEEVNPKGPSAYRVSSWSYRVDMGPSESYGPSVVQLEYVPQQLELSIFWIGQLN

SEQ ID NO: 448 - protein, 506 aa, Tectaria milnei
MAAKDVNTVSELAPAAEEVQNADMAEEDPIFSQLAQKMVAAAEGEEVPVDLLARHLQVEAHDWHNRIRGAILGLISSVSMVGAGVSMLIGLFWPERKVDIWEALNLEEYIKNIVQQQLFEFEMRLLRDDIEALQTTVVRYDRAALTEKGNFLSIWISQADALYIRMRNSTNNIHLPLHMVTVSTLHLAALHERLTFGEELYGTNHSANWTQDLVDKFEMYTTDLFPNVFKRWKDWRPTQIEITAWARNMNCGVVTCRPAMSYATVEDKISGAIFSFQVANQNSTTIFAGVCQDHKTRMVNEAIADMASCLSPTFAFHKLLPVDMQTRFSAYDREQFGQVFRGPYSQDLSHGFWTTNKSFRSHTTRSDIQTTRDRILEVIIRAEAHVDAIQFIYDHADPNATTPGIMAGNPTGSIRYLVDVRDRPIQEMRMEFTYEILSSLQLHFEDGTAQKFGNVNGWASRILTCTAPYGYRFSSWAFREDPGPWNTPAISVLRFQFTPELDFPLS

SEQ ID NO: 449 - protein, 506 aa, Tectaria milnei
MAAKDVNTVSELAPAAEEVQNADMAEEDPIFSQLAQKMVAAAEGEEVPVDLLARHLQVEAHDWHNRIRGAILGLISSVSMVGAGVSMLIGLFWPSNKVDIWEALNFEEYIKNIVQQQLFEFEMRLLWDEIEALETTVVRYNRAALTEKGNFLSIWISQADALYIRMRNSTNNIHLLLHMVTVSTLHLAALHERLTFGEELYGTNHSANWTQDLVDKFEMYTTDLFPNVFKRWKDWRPTQIEITAWARNMNCGVVTCRPAMSYATVEDKVSGAIFSFQVANQNSTTIFAGVCQDHKTRMVNEAIADMASCLSPTFAFHKLLPVDMQTRFSAYDREQFGQVFRGTYSQDLSHGFWTTNKSFRSHTTRSDIQTTRDRILEVIIRAEAHVDAIQFIYDHADPNATTPGIMAGNPTGSIRYLVDVRDRPIQEMRMEFTYEILSSLQLHFEDGTAQKFGNVNGWASRILTCTAPYGYRFSSWAFREDPGPWNTPAISVLRFQFTPELDFPLS

SEQ ID NO: 450 - protein, 506 aa, Tectaria milnei
MAAKDVNTVSELAPAAEEVQNADMAEEDPIFSQLAQKMVAAAEGEEVPVDLLARHLQVEAHDWHNRIRGAILGLISSVSMVGAGVSMLIGLFWPSNKVDIWEALNFEEYIKNIVQQQLFEFEMRLLWDEIEALETTVVRYNRAALTEKGNFLSIWISQADALYIRMRNSTNNIHLLLHMVTVSTLHLAALHERLTFGEELYGTNHSANWTQDLVDKFEMYTTDLFPNVFKRWKDWRPTQIEITAWARNMNCGVVTCRPAMSYATVEDKVSGAIFSFQVANQNSTTIFAGVCQDHKTRMVNEAIADMASCLSPTFAFHKLLPVDMQTRFSAYDREQFGQVFRGPYSQDLSHGFWTTNKSFRSHTTRSDIQTTRDRILEVIIRAEAHVDAIQFIYDHADPNATTPGIMAGNPTGSIRYLVDVRDRPIQEMRMEFTYEILSSLQLHFEDGTAQKFGNVNGWASRILTCTAPYGYRFSSWAFREDPGPWNTPAISVLRFQFTPELDFPLS

SEQ ID NO: 451 - protein, 506 aa, Tectaria milnei
MAAKDVNTVSELAPAAEEVQNADMAEEDPIFSQLAQKMVAAAEGEEVPVDLLARHLQVEAHDWHNRIRGAILGLISSVSMVGAGVSMLIGLFWPSNKVDIWEALNFEEYIKNIVQQQLFEFEMRLLRDDIEALQTTVVRYDRAALTEKGNFLSIWISQADALYIRMRNSTNNIHLLLHMVTVSTLHLAALHERLTFGEELYGTNHSANWTQDLVDKFEMYTTDLFPNVFKRWKDWRPTQIEITAWARNMNCGVVTCRPAMSYATVEDKISGAIFSFQVANQNSTTIFAGVCQDHKTRMVNEAIADMASCLSPTFAFHKLLPVDMQTRFSAYDREQFGQVFRGPYSQDLSHGFWTTNKSFRSHTTRSDIQTTRDRILEVIIRAEAHVDAIQFIYDHADPNATTPGIMAGNPTGSIRYLVDVRDRPIQEMRMEFTYEILSSLQLHFEDGTAQKFGNVNGWASRILTCTAPYGYRFSSWAFREDPGPWNTPAISVLRFQFTPELDFPLS

SEQ ID NO: 452 - protein, 446 aa, Doryopteris cordata
MSVVASDWNNRIRDAVMKLSSKIPYVGSAASILIGLFWPQNKVDIFEALKADLIKLIRKELLDYELNLHKSEIDALKVTMERYQAAQTHEKAYFLNTWISEADKLSVIFRQSANNIHLIPPVITLALLHLTGLRERLDFGKELYQEDNTIQWKRDLEEMYTTYIVNFLPEIFTKWKAWRADQVEIKAWTEPHPTAIPPFFRIESHATVVDTLNGERKHYSVDLTESTTIFSRVCEAHKTRMCNDAASDMAGCISTTFVFDKLLPDNINNLPKYDKGVFGRMFKGPYSQDLLSSGGDFGLGAPVPTFRISPSQHDYSPSSGPITKVIVREWNTIDALQFVYENQEGMLAGNARGGKRHDVDARGKPLRGLRMGFSNGLLTYVQILYVDAATPSSPTLGNRRGWHCQEAIAHAPTSYKLTSWSFNVDNGPSDTFGPSVIQLEYGPLLD

SEQ ID NO: 453 - protein, 446 aa, Doryopteris cordata
MSVVASDWNNRIRDAVMKLSSKIPYVGSAASILIGLFWPQNKVDIFEALKADLIKLIRKELLDYELNLHKSEIDALKVTMERYQAAQTHEKAYFLNTWISEADKLSVIFRQSANNIHLIPPVITLALLHLTGLRERLDFGKELYQEDNTIQWKRDLEEMYTTYIVNFLPEIFTKWKAWRADQVEIKAWTEPHPTAIPPFFRIESHATVVDTLNGERKHYSVDLTESTTIFSRVCEAHKTRMCNDAASDMAGCISTTFVFDKLLPDNINNLPKYDKGVFGRMFKGPYSQDLLSSGGDFGLGAPVPTFRISPSQHDYSPSSGPITKVIVREWNTIDALQFVYENQEGMLAGNARGGKRHDVDARGKPLRGLRMGFSNGLLTYVQILYVDAATPSSPTLGNRRGWHCQEANAHAPTSYKLTSWSFNVDNGPSDTFGPSVIQLEYGPLLD

SEQ ID NO: 454 - protein, 446 aa, Doryopteris cordata
MSVVASDWNNRIRDAVMKLSSKIPYVGSAASILIGLFWPQNKVDIFEALKADLIKLIRKELLDYELNLHKSEIDALKVTMERYQAAQTHEKAYFLNTWISEADKLSVIFRQSANNIHLIPPVITLALLHLTGLRERLDFGKELYQEDNTIQWKRDLEEMYTTYIVNFLPEIFTKWKAWRADQVEIKAWTEPHPTAIPPFFRIESHATVVDTLNGERKHYSVDLTESTTIFSRVCEAHKTRMCNDAASDMAGCISTTFVFDKLLPDNINNLPKYDKGVFGRMFKGPYSQDLLSSGGDFGLGAPVPTFRISPSQHDYSPSSGPITKVIVREWNTIDALQFVYENQEGMLAGNARGSKRHDVDARGKPLRGLRMGFSNGLLTYVQILYVDAATPSSPTLGNRRGWHCQEANAHAPTSYKLTSWSFNVDNGPSDTFGPSVIQLEYGPLLD

SEQ ID NO: 455 - protein, 446 aa, Doryopteris cordata
MSVVASDWNNRIRDAVMKLSSKIPYVGSAASTLIGIFWPQNKVDIFEALKADLIKLVRKEILDYELNLHNSEIDALRITMERYQAAQMHEKAFFLNTWISEADKLSVIFRQSANNIHLIPPVITLALLHLAGLRERLDFGRELYHEDNTIQWKRDLEEMYTTYIVNFLPDIFTKWKAWRADQVEINAWTEPHPTAIPPFFRIESHATVVDTLTGERKRYSVDLTESTTIFSSVCDAHKSRMCNDAASDMAGCISTTFVFYKLLPDNLKHLPKYDKKVFGRMFKGPYSQDLLLSGGNFGFGHPVSAFRMRPNQHDYSPSSGAITKVVVREWNTIDALQFVYENKEGMLAGNARGGQKHDVDARGKPLRGLRMGFSNGLLTYVQILYLDAATPSSPTFGNRRGWQCQEAIAHAPTFYKLTSWSFKVDNGPSNTSGPSVIQLEYGPLLD

SEQ ID NO: 456 - protein, 446 aa, Doryopteris cordata
MSVVASDWNNRIRDAVMKLSSKIPYVGSAASTLIGIFWPQNKVAIFEALKADLIKLVRKEILDYELNLHNSEIDALRITMERYQAAQTHEKAFFLNTWISEADKLSVIFRQSANNIHLIPPVITLALLHLTGLRERLDFGKELYHEDNTIQWKRDLEEMYTTYIVNFLPDIFTKWKAWRADQVEIKAWTEPHPTAIPPFFRIESHATVVDTLTGERKRYSVDLTESTTIFSSVCDAHKSRMCNDAASDMAGCISTTFVFYKLLSDNLKHLPKYDKKVFGRMFKGPYSQDLLLSGGNFGFGHPVSAFRMRPNQHDYSPSSGAITKVIVREWNTIDALQFVYENKEGMLAGNARGGQRHDVDARGKPLRGLRMGFSNGLLTYVQILYLDAATPSSPTFGNRRGWQCQEAIAHAPTFYKLTSWSFKVDNGPSNTSGPSVIQLEYGPLLD

SEQ ID NO: 457 - protein, 446 aa, Doryopteris cordata
MSVVASDWNNRMRDAVMKLSSKIPYVGSAASILIGLFWPQNKVDIFEALKADLIKLIRKEVLDYELNLHKSEIDALKITIERYQTAQMHEKAYFLNTWISEADKLSVIFRQSGNNIHLIPPVITLALLHLIGLRERLDFGKELYHEDNTIQWKRDLEEMYTTYIVDFLPNIFTKWKAWRADQVEIKAWTEPHPTAIPPFFRIESHATVVDTLTGERKHYSVDLTESRTIFSSVCEAHKTRMCNDAASDMAGCISTSFVFDKLLPDNIHKLPKYDKGVFGRMFKGPYSQDLLLSGGNFGFGCPVPIFRMSPNQHDYSPSSGAITKVIVREWNTIDALQFVYENKEGMLAGNARGGQRHEIDARGKPLRGLRMGFSNGLLTYVQILYLDASTQSSPTFGNRRGWQCHEAIAHAPTSYKLTSWSFKVDSGPSNTLGPSVIQLEYGPLLD

SEQ ID NO: 458 - protein, 452 aa, Asplenium flabellifolium
MTAPAADPKSAQEMITDDVNNVSVPAAAGVEEGQEVTVDLLAKNMQIEAHDWHNRIRDAILGLASAIPKVGAAVSLLISIFWPANKVDIWEALNVEQYIRNIVKQEIFEFEMQLHRSDIEALQSTISRYDTAALREKGNFLSIWISQADQLSIRLRNSTNNIHLLLHIVTVSVLHVAAMHERLMFGKELYGADHTASWTKDLVDLFNMYTVTSIPRLFNEWKQWRESQIEVKAWVVRGAWGNVVSRPDVSHATVEDKLTGEKFTFRATRRNSTTIFSGVCSDHKTRMGNEAIADMASCMSPTFGFHMLLPGDVQTQLPAYDKDLFGRVFRGPYSQDLLQQLFTDLRDFRSRPTRFDQTARDRILQVIIRAGHHVDAIQFLYDHLNPNIMTQGIMAGNSAGGTRHQVDVRDRPIHELRMEFSHNVLASLQLHFEDGTATRRFGNQLNWASRIV

SEQ ID NO: 459 - protein, 452 aa, Asplenium flabellifolium
MTAPAADPKSAQEMITDDVNNVSVPAAAGVEEGQEVTVDLLAKNMQIEAHDWHNRIRDAILGLASAIPKVGAAVSLLISIFWPANKVDIWEALNVEQYIRNIVKQEIFEFEMQLHRSDIEALQSTISRYDTAALREKGNFLSIWISQADQLSIRLRNSTNNIHLLLHIVTVSVLHVAAMHERLMFGKELYGADHTASWTKDLVDLFNMYTVTSIPRLFNEWKQWRESQIEVKAWVVRGAWGNVVSRPDVSHATVEDKLTGEKFTFRATRRNSTTIFSGVCSDHKTRMGNEAIADMASCMSPTFGFHMLLPGDVQTQLPAYDKDLFGRVFRGPYSQDLLQQLFTDLRDFRSRPTRFDQTARDRILQVIIRAGHHVDAIQFLYDHLNPNIMTQGIMAGNSAGGTRHQVDVRDRPTHELRMEFSHNVLASLQLHFEDGTATRRFGNQLNWASRIV

SEQ ID NO: 460 - protein, 494 aa, Davallia pentaphylla
MAGYNHVQDQLVMAADQDVNTVSELAPATDKEDMAVEEDPIFAQLAEKMAAAAAAEKGEAPVDLLAQYMQVEAHDWHNRIRGAILGLISLVPKVGAAVSRLIGLFWPANKVDIWEALKAEEYIRNIVQQELFEFEMRLLQNDIEALEMTVARYDRAALTEKGNFLSIWITQADALYIRMRNSTNNIHLLLHMVTVSTLHMAALHERLTFGEELYGTNNSANWTQDLVDKFERYTTDLFPSVFKRWKEWRPTQIEIRSWINRGSCGNLTCRPNVSHATVEDKTSGAFFSFQSSGSSSTTMFLEVCEDHKTRMVNEAIADMASCLSPTFAFHKLLPDDIQAQFSPYDRQEFGQVFRGPYSQDLSHGAWTNFKNFRSRTTRSDQTLRDRILEVIIRAGSHVDAMQFMYDHVNPSFTTPGTMAGNATGGIRHPVDVRDRPIQELRMEFARDVLASLQLHFEDGTSTQRFGNELFGTWPTRILTCTAPYGYRFSSWAFR

SEQ ID NO: 461 - protein, 479 aa, Davallia pentaphylla
MAGYNHVQDQLVMAADQDVNTVSELAPATDKEDMAVEEDPIFAQLAEKMAAAAAAEKGEAPVDLLAQYMQVEAHDWHNRIRGAILGLISLVPKVGAAVSRLIGLFWPANKVDIWEALKAEEYIRNIVQQELFEFEMRLLQNDIEALEMTVARYDRAALTEKGNFLSIWITQADALYIRMRNSTNNIHLLLHMVTVSTLHMAALHERLTFGEELYGTNNSANWTQDLVDKFERYTTDLFPSVFKRWKEWRPTQIEIRSWINRGSCGNLTCRPNVSHATVEDKTSGAFFSFQSSGSSSTTMFLEVCEDHKTRMVNEAIADMASCLSPTFAFHKLLPDDIQAQFSPYDRQEFGQVFRGPYSQDLSHGAWTNFKNFRSRTTRSDQTLRDRILEVIIRAGSHVDAMQFMYDHVNPSFTTPGTMAGNATGGIRHPVDVRDRPIQELRMEFARDVLASLQLHFEDGTSTQRFGNELFGDHKSGVSC

SEQ ID NO: 462 - protein, 494 aa, Davallia pentaphylla
MAGYNHVQDQLVMAADQDVNTVSELAPATDKEDMAVEEDPIFAQLAEKMAAAAAAEKGEAPVDLLAQYMQVEAHDWHNRIRGAILGLISLVPKVGAAVSRLIGLFWPANKVDIWEALKAEEYIRNIVQQELFEFEMRLLQNDIEALEMTVARYDRAALTEKGNFLSIWITQADALYIRMRNSTNNIHLLLHMVTVSTLHMAALHERLTFGEELYGTNNSANWTQDLVDKFERYTTDLFPSVFKRWKEWRPTQIEIRSWINRGSCGNLTCRPNVSHATVKDKTSGAFFSFQSSGSSSTTMFLEVCEDHKTRMVNEAIADMASCLSPTFAFHKLLPDDIQAQFSPYDRQEFGQVFRGPYSQDLSHGAWTNFKNFRSRTTRSDQTLRDRILEVIIRAGSHVDAMQFMYDHVNPSFTTPGTMAGNATGGIRHPVDVRDRPIQELRMEFARDVLASLQLHFEDGTSTQRFGNELFGTWPTRILTCTAPYGYRFSSWAFR

SEQ ID NO: 463 - protein, 507 aa, Microsorum commutatum
MAALHMKNSSEMIGGAVATPTDVVTSGREGATAAAEESLDNEVALEGGNDDIDVLANNMQLEAHDWHNRTRGAVLALLSAIPKVGGAISTLVGLFWPANKVDIWEALNMEAYVTNIVRREIMEFEMRQLEGDIEALENTIQRYERGSLAEKAIHLGIWIERADALSIRLANSSNRIHLLLHIVTVAVLHMAALHERLTYGEELYGTNNSVNWTKELEQQFHTYTSNRIPTIFKEWSPWRESQIEITSSRRRQQIGAVNFRPSNSSATVEDKISGETITFSIDYEYSLTIFSDICNAHKTRMMNQATADMASCMSPTFIFHKLLPNDIQSKVSPYDRQVFGQVFQGPYSQDLLQPRITGRKAFTLHPTRFDQTARTKILQVTVRAGSLLEAIQFWYDHATPNAMTPGVMAGNPRGGTISNVDVKTRRIQDLRLEFSRNVLVSLQIRFEDGTSTQKFGNITGWYTSTKTCTAPSGYRLSSWAFREDTGPNNTTAISVVRFQFTPDDPLP

SEQ ID NO: 464 - protein, 511 aa, Pyrrosia rupestris
MAGYNHVQDQLVMAADQDVNTVSELAPATDKVQNEDMVEEDPIFAQLAEKMAAAAEKGEAPVDLLAQYMQVEAHDWHNRIRGAILGLISLVPKVGAAVSRLIGLFWPANKVDIWEALKAEEYIRNIVQQELFEFEMRLLQDDIEALEMTVARYDRAALTEKGNFLSIWISQADALYIRMRNSTNNIHLLLHMVTVSTLHMAALHERLTFGEELYGTNNSANWTQDLVDKFERYTADLIPSVFKRWKEWRPTQIEIRAWINRGSCGNLTCRPNVSHATVEDKTSGARFSFQSSGSSSTTMFSEICEDHKIRMVNEAIADMASCLSPTFAFHKLLPDDIQAQFSPYDRQEFGQVFRGPYSQDLSHGAWTNFKNFRSRTTRSDQTLRDRILEVIIRAGSHVDALQFIYDHVNPNSMTPGIMAGNAAGGVRHQVDVRDRPIQEVRMEFARDVLASLQLHFEDGTSTQKFGNELFGTWATRILTCTAPYGYRFSSWAFREDPGPYRTTAISVLRFQ

SEQ ID NO: 465 - protein, 511 aa, Pyrrosia rupestris
MAGYNHVQDQLVMAADQDVNTVSELAPATDKVQNGDMVEEDPIFAQLAEKMAAAAEKEEAPVDLLAQYMQVEAHDWHNRIRGAILGLISAVPKVGAAISGLIGLFWPANKVDIWEALRAEEYIRNIVQQELFEFEMRLLQNDIEALEMTVGRYDTAALTEKGNFLSIWISQADALYIRMRNSTNNIHLLLHMVTVSTLHMAALHERLTFGEELYGTNNSANWTADLVDKFERYTTDLIPNVFKRWKEWRPTQIEITARRRRGSCGIVTCSPNVSYATVEDKISGATFSFQATNQYSLTIFSEVCEDHKTRMVNEAVADMASCLSPTFAFHKLLPDNIQGQFSPYDRQQFGQVFRGPYSQDLSHGLWTVFKNFRSRTTRSDQTLRDRILQVIIRAGSHVDALQFVYDHANPNSTTPGTLAGNATGGIRHQVNVRDPPIQELRMEFARDVLASLQLHFADGTSTQKFGNVIFGTWATRILTCTAPYGYRFSSWAFREDPGPYRTTAISVLRFQ

SEQ ID NO: 466 - protein, 511 aa, Pyrrosia rupestris
MAGYNHVQDQLVMAADQDVNTVSELAPATDKVQNEDMVEEDPIFAQLAEKMAAAAEKGEAPVDLLAQYMQVEAHDWHNRIRGAILGLISLVPKVGAAVSRLIGLFWPANKVDIWEALKAEEYIRNIVQQELFEFEMRLLQDDIEALEMTVARYDRAALTEKGNFLSIWISQADALYIRMRNSTNNIHLLLHMVTVSTLHMAALHERLTFGEELYGTNNSANWTQDLVDKFERYTADLIPSVFKRWKEWRPTQIEIRAWINRGSCGNLTCRPNVSHATVEDKTSGARFSFQSSGSSSTTMFSEICEDHKIRMVNEAIADMASCLSPTFAFHKLLPDDIQAQFSPYDRQQFGQVFRGPYSQDLSHGLWTVFKNFRSRTTRSDQTLRDRILQVIIRAGSHVDALQFVYDHANPNSTTPGTLAGNATGGIRHQVNVRDPPIQELRMEFARDVLASLQLHFADGTSTQKFGNVIFGTWATRILTCTAPYGYRFSSWAFREDPGPYRTTAISVLRFQ

SEQ ID NO: 467 - protein, 511 aa, Pyrrosia rupestris
MAGYNHVQDQLVMAADQDVNTVSELAPATDKVQNGDMVEEDPIFAQLAEKMAAAAEKEEAPVDLLAQYMQVEAHDWHNRIRGAILGLISAVPKVGAAISGLIGLFWPANKVDIWEALRAEEYIRNIVQQELFEFEMRLLQNDIEALEMTVGRYDTAALTEKGNFLSIWISQADALYIRMRNSTNNIHLLLHMGTVSTLHMAALHERLTFGEELYGTNNSANWTADLVDKFERYTTDLIPNVFKRWKEWRPTQIEITARRRRGSCGIVTCSPNVSYATVEDKISGATFSFQATNQYSLTIFSEVCEDHKTRMVNEAVADMASCLSPTFAFHKLLPDNIQGQFSPYDRQQFGQVFRGPYSQDLSHGLWTVFKNFRSRTTRSDQTLRDRILQVIIRAGSHVDALQFVYDHANPNSTTPGTLAGNATGGIRHQVNVRDPPIQELRMEFARDVLASLQLHFADGTSTQKFGNVIFGTWATRILTCTAPYGYRFSSWAFREDPGPYRTTAISVLRFQ

SEQ ID NO: 468 - protein, 511 aa, Pyrrosia rupestris
MAGYNHVQDQLVMAADQDVNTVSELAPATDKVQNGDMVEEDPIFAQLAEKMAAAAEKEEAPVDLLAQYMQVEAHDWHNRIRGAILGLISAVPKVGAAISGLIGLFWPANKVDIWEALRAEEYIRNIVQQELFEFEMRLLQNDIEALEMTVGRYDTAALTEKGNFLSIWISQADALYIRMRNSTNNIHLLLHMVTVSTLHMAALHERLTFGEELYGTNNSANWTTDLVDKFERYTTDLIPNVFKRWKEWRPTQIEITARRRRGSCGIVTCSPNVSYATVEDKISGATFSFQATNQYSLTIFSEVCEDHKTRMVNEAVADMASCLSPTFAFHKLLPDNIQGQFSPYDRQQFGQVFRGPYSQDLSHGLWTVFKNFRSRTTRSDQTLRDRILQVIIRAGSHVDALQFVYDHANPNSTTPGTLAGNATGGIRHQVNVRDPPIQELRMEFARDVLASLQLHFADGTSTQKFGNVIFGTWATRILTCTAPYGYRFSSWAFREDPGPYRTTAISVLRFQ

SEQ ID NO: 469 - protein, 511 aa, Pyrrosia rupestris; identical to SEQ ID NO: 467

SEQ ID NO: 470 - protein, 526 aa, Pyrrosia rupestris
MAGYNHVQDQLVMAADQDVNTVSELAPATDKVQNGDMVEEDPIFAQLAEKMAAAAEKEEAPVDLLAQYMQVEAHDWHNRIRGAILGLISAVPKVGAAISGLIGLFWPANKVDIWEALRAEEYIRNIVQQELFEFEMRLLQNDIEALEMTVGRYDTAALTEKGNFLSIWISQADALYIRMRNSTNNIHLLLHMVTVSTLHMAALHERLTFGEELYGTNNSANWTADLVDKFERYTTDLIPNVFKRWKEWRPTQIEITARRRRGSCGIVTCSPNVSYATVEDKISGATFSFQATNQYSLTIFSEVCEDHKTRMVNEAVADMASCLSPTFAFHKLLPDNIQGQFSPYDRQQFGQVFRGPYSQDLSHGLWTVFKNFRSRTTRSDQTLRDRILQVIIRAGSHVDALQFVYDHANPNSTTPGTLAGNATGGIRHQVNVRDPPIQELRMEFARDVLASLQLHFADGTSTQKFGNVIFGTWATRILTCTAPYGYRFSSWAFREDPGPYRTTAISVLRFQFTPELDMPLPSAYLI

SEQ ID NO: 471 - protein, 445 aa, Pyrrosia rupestris
MAGYNHVQDQLVMAADQDVNTVSELAPATDKVQNGDMVEEDPIFAQLAELFEFEMRLLQNDIEALEMTVGRYDTAALTEKGNFLSIWISQADALYIRMRNSTNNIHLLLHMVTVSTLHMAALHERLTFGEELYGTNNSANWTADLVDKFERYTTDLIPNVFKRWKEWRPTQIEITARRRRGSCGIVTCSPNVSYATVEDKISGATFSFQATNQYSLTIFSEVCEDHKTRMVNEAVADMASCLSPTFAFHKLLPDNIQGQFSPYDRQQFGQVFRGPYSQDLSHGLWTVFKNFRSRTTRSDQTLRDRILQVIIRAGSHVDALQFVYDHANPNSTTPGTLAGNATGGIRHQVNVRDPPIQELRMEFARDVLASLQLHFADGTSTQKFGNVIFGTWATRILTCTAPYGYRFSSWAFREDPGPYRTTAISVLRFQFTPELDMPLPSAYLI

SEQ ID NO: 472 - protein, 517 aa, Arthropteris tenella
MPGYHVQDQLVMAAKDVNIASELAPAAEEVQNADMAEEDPIFSQLAQKMVAAAEREEVPVDLLAQYMQVEAHDWHNRIRGAILGLISAVPKVGAAISRLIGLFWPSNKVDIWEALNAEEYIRNIVQQELFEFEMQLLRNDIEALETTVVRYDRAALTEKGNFLSIWISQADALYIRMRNSTNNIHLLLHMVTVSTLHMAALHERLTFGEELYGSNNSANWTQDLVDKFEMYTTDLIPNVFKRWKDWRPTQIVITAWARNMQCGNLTCRPAMSYATVEDKISGALFSFQATNQNSTTIFLGVCQDHKTRMVNEAVADMASCLSPTFAFHKLLPDDIQTRFSPFDREQFGQVFRGPYSQDLSHGFWTVHKAFRSHTTRSDQTTRDRILEVIIRAGHHVDAIQFLYDHVNPNATTPGIMAGNSAGGIRHQVDVRDRRIQDLRMEFYQDVLASLQLHFEDGTSTRKFGNELGWATRILTCTAPYGYRFSSWAFREDPGPYRTPAISVLRFQFTPELDIPLP

SEQ ID NO: 473 - protein, 510 aa, Stenochlaena palustris
MATTGMKDTALIVAEDNATVKSDVQPAEGLLDLNSLAAAGVGAGDEVTTDLLAKYMEMEAHDWHNRVRAAVLGLISAVPKVGAAVSKLIGFFWPSNKVDIWEAINAEQYVRNIVKQEIFEFEMQQHQSDIEALQTTVSRYDRAATTEKGNFLSIWISQADALCIRLRNSSNNIHLLLHIVTVAVLHVAALHERLAFGEELYGSNNTANWTKDLVDVFEMYTSDLIPNLFKEWRQWRESQIEIRAWVVPGRWGNLVSTPDVSHATVEDKISGEKFAFQVARQNSTTIFANVCEDHRNRMSNEAIADMASCISPTFGFHKLLPDNVQTQFSPYNEELFGQVFRGPYSQDLMQPLFTTLKTFRTRPTRFDQTARNRILEVIIRSGHHIDAIQFWYDHVNPNSMTAGTMAGNSAGGSRHWVDVRDRPIQDLRMEFSHDVLASLQLHFEDGTSTRKFGNELGWASNIVTCTTPYGYRLSSWAFREDPGPYRTTAISVLRFQFTPEEFTPEDPSSL

SEQ ID NO: 474 - protein, 510 aa, Stenochlaena palustris
MATTGMKDTALIVAEDNATVKSDVQPAEGLLDLNSLAAAGVGAGDEVTTDLLAKYMEMEAHDWHNRVRAAVLGLISAVPKVVAAVSKLIGFFWPSNKVDIWEAINAEQYVRNIVKQEIFEFEMQQHQSDIEALQTTVSRYDRAATTEKGNFLSIWISQADALCIRLRNSSNNIHLLLHIVTVAVLHVAALHERLAFGEELYGSNNTANWTKDLVDVFEMYTSDLIPNLFKEWRQWRESQIEIRAWVVPGRWGNLVSTPDVSHATVEDKISGEKFAFQVARQNSTTIFANVCEDHRNRMSNEAIADMASCISPTFGFHKLLPDNVQTQFSPYNEELFGQVFRGPYSQDLMQPLFTTLKTFRTRPTRFDQTARNRILEVIIRSGHHIDAIQFWYDHVNPNSMTAGTMAGNSAGGSRHWVDVRDRPIQDLRMEFSHDVLASLQLHFEDGTSTRKFGNELGWASNIVTCTTPYGYRLSSWAFREDPGPYRTTAISVLRFQFTPEEFTPEDPSSL

SEQ ID NO: 475 - protein, 514 aa, Unknown
  Unknown Species of the Genus Elaphoglossum from commercial collection
MAAPGLMSSAVHDIVSARATTKGVPDVVVEDHGIQILSVSAEAAVEETDVVVEQPQRVLQLPDYYIEVTADDWHNRIRSAILQLASGIPVVGSAVSILVGLFWPSNKVNIFESIKGEKYIRNIVKQELFEYELGERISEIEALEDTIKQYDRAGPREKAGFLTAWLTDSNQLAIRLRNSPNNIHLLLHIVTVATLHMAALHERLTFGMELYQEDNRTIWSEDLVTEFRKYAFDVLPTVFGVWKAWRESQVQIETWTRRGGGNINWTPDSSHATVEDKHSGEIFRFTRTYIRSTTIFLPVCEDHRTRMWNEAVADMASYISPTFAFHKLLPDDVQRLHPAYDEQQFGRVFRGPYSRDLLWNNVSGSGAIDFRSSTDRNDFVTSRHGVVEVTIRTGHHVDAIQFRYGAANSGTLLGVMAGNSRGGTLRQFDVRSRAIESVRMEFAYNILAAIQLNFDDGTTTRRLGNELDWSTWVVTSTTPFGYTLSSWAYRQDNGPYGTAAPSVLRFQYAPPIEP

SEQ ID NO: 476 - protein, 514 aa, Unknown
  Unknown Species of the Genus Elaphoglossum from commercial collection
MAAPGLMSSAVHDIVSARATTKGVPDVVVEDHGIQILSVSAEAAVEETDVVVEQPQRVLQLPDYYIEVTADDWHNRIRSAILQLASGIPVVGSAVSILVGLFWPSNKVNIFESIKGEKYIRNIVKQELFEYELGERISEIEALEDTIKQYDRAGPREKAGFLTAWLTDSNQLAIRLRNSPNNIHLLLHIVTVATLHMAALHERLTFGMELYQEDNRTIWSEDLVTEFRKYAFDVLPTVFGVWKAWRESQVQIETWTRRGGGNINWTPDSSHATVEDKHSGEIFRFTRTYIRSTTIFLPVCEDHRTRMWNEAVADMASYISPTFAFHKLLPDDVQRLHPAYDEQQFGRVFRGPYSRDLLWNNVSGSGAIDFRSSTDRNDFVTSRHGVVEVTIRTGHHVDAIQFRYGAANSGTLLGVMAGNSRGGTLRQFDVRSRAIESARMEFAYNILAAIQLNFDDGTTTRRLGNELDWSTWVVTSTTPFGYTLSSWAYRQDNGPYGTAAPSVLRFQYAPPIEP

SEQ ID NO: 477 - protein, 514 aa, Unknown
  Unknown Species of the Genus Elaphoglossum from commercial collection
MAAPGLMSSAVHDIVSARATTKGVPDVVVEDHGIQILSVSAEAAVEETDVVVEQPQRVLQLPDYYIEVTADDWHNRIRSAILQLASGIPVVGSAVSILVGLFWPSNKVNIFESIKGEKYIRNIVKQELFEYELGERISEIEALEDTIKQYDRAGPREKAGFLTAWLTDSNQLAIRLRNSPNNIHLLLHIVTVTTLHMAALHERLTFGMELYQEDNRTIWSEDLVTEFRKYAFDVLPTVFGVWKAWRESQVQIETWTRRGGGNINWTPDSSHATVEDKHSGEIFRFTRTYIRSTTIFLPVCEDHRTRMWNEAVADMASYISPTFAFHKLLPDDVQRLHPAYDEQQFGRVFRGPCSRDLLWNNVSGSGAIDFRSSTDRNDFVTSRHGVVEVTIRTGHHVDAIQFRYGAANSGTLLGVMAGNSRGGTLRQFDVRSRAIESVRMEFAYNILAAIQLNFDDGTTTRRLGNELDWSTWVVTSTTPFGYTLSSWAYRQDNGPYGTAAPSVLRFQYAPPIEP

SEQ ID NO: 478 - protein, 521 aa, Myriopteris
MAADQTDVNTSAVADDQEDLQDADSCKEDPDYSQVAQAMVAAGAAAAAEGKEVGLVDVIDKYMHIQAHDWHNRIRGALLALLSKIPTVGSAVSMLVGFFWPANRVDIWEAIKAEERVRNIVQQELFEFEMQLLKDEIEALETVVARYNNTAVLTEKGNFLSIWITQADRLYIRMRNSANNIHLLLHIVTVSVLHVAGLHERLTFGEQLYGASNTANWTQDLVTVVRSYTVDLIPDLFKKWKEWRESQIEIRAWVVRGTCGFLNCRPDVSHATVEDKMSGAIFRFQATNRNSTTIFSGICQDHKIRMANDAIADMAGCLSPTFALHKLLPLHSQGQFSAYDREQFGRIFRGPYSQDLTHGLFTFVKAFRSNITMPDETSSRDRVLEVTIRAGAHVDAIQFWYDHVNPNAMTAGILAGNSLGGSRHQVDVRQRAIQDLRMEFSYDVLASLQLHFEDGSSTAKFGNAENWATRIVTCSTPLGYRVSSWGFRVDAGPYGLSISVLRFQFTPELDYIAPPPNSLTN

SEQ ID NO: 479 - protein, 537 aa, Myriopteris
MAADQTDVKTDVNTSGVAADQTDVNTSAVADDQEDLQDADSCKEDPDYSQVAQAMVAAGAAAAAEGKEVGLVDVIDKYMHIQAHDWHNRIRGALLALLSKIPTVGSAVSMLVGFFWPANRVDIWEAIKAEERVRNIVQQELFEFEMQLLKDEIEALETVVARYNNTAVLTEKGNFLSIWITQADRLYIRMRNSANNIHLLLHIVTVSVLHVAGLHERLTFGEQLYGASNTANWTQDLVTVVRSYTVDLIPDLFKKWKEWRESQIEIRAWVVRGTCGFLNCRPDVSHATVEDKMSGAIFRFQATNRNSTTIFSGICQDHKIRMANDAIADMAGCLSPTFALHKLLPLHSQGQFSAYDREQFGRIFRGPYSQDLTHGLFTFVKAFRSNITMPDETSSRDRVLEVTIRAGAHVDAIQFWYDHVNPNAMTAGILAGNSLGGSRHQVDVRQRAIQDLRMEFSYDVLASLQLHFEDGSSTAKFGNAENWATRIVTCSTPLGYRVSSWGFRVDAGPYGLSISVLRFQFTPELDYIAPPPNSLTN

SEQ ID NO: 480 - protein, 516 aa, Drynaria sparsisora
MVASDMKDSEMIGGDVAPATLVSEENAQTIAEDANNTTVGSEAAGELDKLALEGGDNVVDVLARQMQVEAHDWHNRVRGAVLGLTSAVPMVGRAISNLIGLFWPANRVNIWEALNAEAYITNIVRREIFEFEMRLHESDIEALERTILRYDRASLLHEKGIFLANWIVQADALCIRLRNSTNRIHLLLHIVTVAVLHMAALHERLTFGEELYGANNTANWTTELVEQFERYTIDKVPNIFEEWRPWRESQIQITEWRVAGQCGNLTCRPAVSHATVEDKVSGETFVFRATNVFSTTIFSDLCRDHRTRMMNEAVADMASCMSPTFAFHTLLPTSDIQMQFSPFDRRVFGQVFRGPYSWHLLQHQLFYTSGRISFITRPTRFDQTDRDRVLQVTISEGLRLEGMQFWYDHADPSAMTPGMMAGNFTVGRPIIVDVDVRNRPIQHLHMEFATDGLVSLQIQFEDGTSTRKFGNGMSHWIGDKVACTTPSGYRLSSWACTTPSTFDLVRFEFTPEIPST

SEQ ID NO: 481 - protein, 516 aa, Drynaria sparsisora
MVASDMKDSEMIGGDVAPATLVSEENAQTIAEDANNTTVGSEAAGELDKLALEGGDNVVDVLARQMQVEAHDWHNRVRGAVLGLTSAVPMVGRAISNLIGLFWPANRVNIWETLNAEAYITNIVRREIFEFEMRLHESDIEALERTILRYDRASLLHEKGIFLANWIVQADALCIRLRNSTNRIHLLLHIVTVAVLHMAALHERLTFGEELYGANNTANWTTELVEQFERYTIDKVPNIFEEWRPWRESQIQITEWRVAGQCGNLTCRPAVSHATVEDKVSGETFVFRATNVFSTTIFSDLCRDHRTRMMNEAVADMASCMSPTFAFHTLLPTSDIQMQFSPFDRRVFGQVFRGPYSWHLLQHQLFYTSGRISFITRPTRFDQTDRDRVLQVTISEGLRLEGMQFWYDHADPSAMTPGMMAGNFTVGRPIIVDVDVRNRPIQHLHMEFATDGLVSLQIQFEDGTSTRKFGNGMSHWIGDKVACITPSGYRLSSWACTTPSTFDLVRFEFTPEIPST

SEQ ID NO: 482 - protein, 508 aa, Thelypteris noveboracensis
MAAPAMVHSEMIAEDVNTVSVLAPPAEELQDSVYTQLAQQMIAAQEAGQEVTVDLLAKYMQIEAHDWHNRTRRAILGLISLAGTVGAGVSMLISLFWPATKVDIWEAINGNQYVRNIIRQEIFEFELHQHRSEIQALETTVSRYNTAGGPIERGNFLSLWITQADRLSILLRNSTNNIHLLLHIVTVAVLHVAALHERLTFGKELYGQDNTANWKQDLVDVFEMYTSNALPNIFNKWKEWRATEIEITAWRVRAQHGNLIYRPSSSHATVEDKISGEKFRFQVTSEYSTTIFSEVCQDHKTRMMNEAIADMASCLSPTFAFHKLLPDDIQTQFSPYDEVAFGRVFRGPYSQDLLQSAFTRFKAFRSRATRFDQTTRDRILQVIIRAGNLVDAIQFWYDNWNPNAMTAGIMAGHPTGGTRHQVDVRDRPIQELRMGFASDVLTWLQLRFEDGTSTQQFGSSGWASNIVTCTAPYGYRLSSWAFREDPGPFSTPAISVLRFQFTPDDIRD

SEQ ID NO: 483 - protein, 508 aa, Thelypteris noveboracensis
MAAPAMVHSEMIAEDVNTVSVLAPPAEELQDSVYTQLAQQMIAAQEAGQEVTVDLLAKYMQIEAHDWHNRTRRAILGLISLAGTVGAGVSMLISLFWPATKVDIWEAINGNQYVRNIIRQEIFEFELNQHRSEIQALETTVSRYNTAGGPIERGNFLSLWITQADRLSILLRNSTNNIHLLLHIVTVAVLHVAALHERLTFGKELYGQDNTANWKQDLVDVFEMYTSNALPNIFNKWKEWRATEIEITAWRVRAQHGNLFYRPSSSHATVEDKISGEKFRFQVTSEYSTTIFSEVCQDHKTRMMNEAIADMASCLSPTFAFHKLLPDDIQTQFSPYDEVAFGRVFRGPYSQDLLQSAFTRFKAFRSRATRFDQTTRDRILQVIIRAGNLVDAIQFWYDNWNPNAMTAGIMAGHPTGGTRHQVDVRDRPIQELRMGFASDVLTWLQLHFEDGTSTQQFGSSGWASNIVTCTAPYGYRLSSWAFREDPGPFSTPAISVLRFQFTPDDIRD

SEQ ID NO: 484 - protein, 508 aa, Thelypteris noveboracensis
MAAPAMVHSEMIAEDVNTVSVLAPPAEELQDSVYTQLAQQMIAAQEAGQEVTVDLLAKYMQIEAHDWHNRTRRAILGLISLAGTVGAGVSMLISLFWPATKVDIWEAINGNQYVRNIIRQEIFEFELHQHRSEIQALETTVSRYNTAGGPIERGNFLSLWITQADRLSILLRNSTNNIHLLLHIVTVAVLHVAALHERLTFGKELYGQDNTANWKQDLVDVFEMYTSNALPNIFNKWKEWRATEIEITAWRVRAQHGNLIYRPSSSHATVEDKISGEKFRFQVTSEYSTTIFSEVCQDHKTRMMNEAIADMASCLSPTFAFHKLLPDDIQTQFSPYDEVAFGRVFRGPYSQDLLQSAFTRFKAFRSRATRFDQTTRNRILQVIIRAGNLVDAIQFWYDNWNPNAMTAGIMAGHPTGGTRHQVDVRDRPIQELRMGFASDVLTWLQLRFEDGTSTQQFGSSGWASNIVTCTAPYGYRLSSWAFREDPGPFSTPAISVLRFQFTPDDIRD

SEQ ID NO: 485 - protein, 508 aa, Thelypteris noveboracensis
MAAPAMVHSEMIAEDVNTVSVLAPPAEELQDSVYTQLAQQMIAAQEAGQEVTVDLLAKYMQIEAHDWHNRTRRAILGLISLAGTVGAGVSMLISLFWPATKVDIWEAINGNQYVRNIIRQEIFEFELHQHRSEIQALETTVSRYNTAGGPIERGNFLSLWITQADRLSILLRNSTNNIHLLLHIVTVAVLHVAALHERLTFGKELYGQDNTANWKQDLVDVFEMYTSNALPNIFNKWKEWRATEIEITAWRVRAQHGNLIYRPSSSHATVEDKISGEKIRFQVTSEYSTTIFSEVCQDHKTRMMNEAIADMASCLSPTFAFHKLLPDDIQTQFSPYDEVAFGRVFRGPYSQDLLQSAFTRFKAFRSRATRFDQTTRDRILQVIIRAGNLVDAIQFWYDNWNPNAMTAGIMAGHPTGGTRHQVDVRDRPIQELRMGFASDVLTWLQLHFEDGTSTQQFGSSGWASNIVTCTAPYGYRLSSWAFREDPGPFSTPAISVLRFQFTPDDIRD

SEQ ID NO: 486 - protein, 499 aa, Pteris ensiformis
MAGIKDSEMIGDVVVTPTAVSVPAGELEVQDLDQLGLEVTNNIDVLAKYMQMEAHDWHNRTRGAVLGLISAIPKVGAAISMLIGLFWPANKVDIWVALNAEEYVRNIVKQEIFEFEMQQHQSEIEALEATILRYDRAALTEKRNFLSIWISQADRLCIRLRNSSNNIHLLLHIVTVAVLHIAAMHERLTFGEELYGTNHTTNWTKDLVDVFEMYTSNLIPNIFKQWRQWRESEIEIKAWVVRGVWGNLTQTPDVSHATVEDKISGEKFTFRATRQNSTTIFSDVCQAHKTRMANEAVADMASCMSPTFAFHKLLPNNIQTQFSPYDKDLFAQVFRGPYSQDLLQPLFTALKSFRTRPTRFDQTARDKILEVTIRAGHHIDAIQFWYDHVNPNTMTAGTMAGNSTGGSRHQVNVRNQRIQDLRLEFSQDVLASLQLHFEDGTSTRKFGNEMGWASRIVTCTTPAGYRLSSWAFREDRGPYNTTAISVLRFQFTPDEDASS

SEQ ID NO: 487 - protein, 507 aa, Polystichum tripteron
MAAPGMMDSEMIAEDVHDVLAPAPEVEVQDSVYPQLAQEMIADAAAEEVTVDRLAKYMQVEAHDWHNRTRGAILGLISAIPKVGAGISFLIGLFWPANKVDIWEAINAEQYVRNIVKQEIYEFELRQLRSDIEALQTTVGRYDTAAPNERGHYLSNWITQADILYFRMRDSTNNIHLLLHIVTVAVLHIAALHERLTFGEELYGANNTANWTRALVEVFEMYTSNLIPNLFNKWKEWRESQIVITAWRVRGQSGLTIFRPDVSHATVEDTVSGEKFTFQASYHYSTTIFSEVCRDHKTRMTNEAIADMASCLSPTFAFHKLLPDDIQTQFSPYDRGAFGAVLRGPYSWDLSQPLFTTLKAFRSRPTRFDQTARDRVLEVIIRAGHHVDAVQFFYDHASPNGTTAGTMAGNSAGGSRNVVDVRSRSIQKLRMGFSRDVLASLQLQFEDGTSTRQFGNELGWASTIVTCTAPFGYRLSSWAFREDPGPYNTTAISLLRFQFTPDDIPSS

SEQ ID NO: 488 - protein, 527 aa, Asplenium athertonense
MDSDTIVDAPQADVNAASVQAPAAKKVHEDQSVMTTPDQMEESVDPQFEQEMSSVSALIAAGAVEGHDDVDLFEKYMHVEAHDWQNRLRQAILGLASKIPKVGFAISALIGLFWPPNRVSIWEAINGEVYVRNIVRQELFEFEVRLLKSDIEALETVIHRYDQAASTLEKGNFLSIWISQADGLLIRMRRSTNNIHLLLHIVTVAVLHMAALHERLTFGEELYGSNNTANWKQALVEMFEEYTINLIPTLFREWRQWRDSQIEIRQWAVRGRWGNVVASPDSSHATVEDKFARQLFTFRVIRRYSTTIFSGVTQDQRTRMMNEATADMASCISPTFAFHEILPNDVKTRFSPYDKELFGRVFRGPYSQDLMQPLFTTFRDFRSHPRRSDPTTPGRVVEVTIRAGHHVDAIQLWYDHANSNSATAGLMAGNPTGGTRHQINVRDRPIQQFRMEFAHDTLASLQLHFQDGTSTRKFGNELGWASRIATCTAPYGYKLSSWAFREDPGPYGTAAISLLRFDFTPEHPSSI

SEQ ID NO: 489 - protein, 497 aa, Lindsaea brachypoda
MAAPAGTTDSEVIADVVTPAAAAAGEVLDLDRLGLELTSNNIDVLAKYMQMEAHDWHNRMRDAVLALMSQIPTVGGAVSMLIGLFWPAKKVNIWLALNAEAYVRNIVKQEIFEFEMQQHQSSIEALEATISRYDRAVLTEKGNFLSIWISQADALIIRLRNSTNNIHLLLHIATVAVLHVAAMHERLTFGEELYGTNNTANWRKDFVDVFQMYTSNLVPNVFKEWKQWRENEIEIKAWVVKGVWGTVVSTPDVSHATVEDKFSGEKFTFRVARQNSTTIFSNVCQDHKTRMMNEAIADMASCMSPTFAFHKLLPSDIQTQFPPYDKKLFGQVFRGPYSQDLLQPLFTNLKSFRTRPTRFDQTARDRILEVIIRAGHHVDAIQFWYDHVNPNAMTAGTMAGNSTGGSRHQVDVRNRRIQDLRLEFSQDVIASLQIHFEDGTSTRKFGNEMGWATNIVTCTTPAGYRLSSWAFREDLGPYTTTAISVLRFQFTPEDPSP

SEQ ID NO: 490 - protein, 472 aa, Adiantum aethiopicum
MQAAAAVKGQELPVVDLIDKYMQVQAHDWHNRIRGAILGLISLVPVVGRGVSKLVGLFWPTTKVDIWEALKMEQYIRNIVQQEIFEFEMRQLQSDIEALETTVGRYDRATSLIEKGNFLSIWITQADALYFRMRDSTNNIHLLLHIVTVSTLHIAALHERLTFGEELYGSNNAANWTRDLVDKFRLYTVDLLPSIFQRWKVWREAQIEIRAWIDWGSCGNLTCRPNVSHATVHDKVSGVVLAFRAQNRASTTIFSGLCEGHKTRMRNEAVADMASCLSPTFAFHKLLPDNIQPQFSAFDRQQFGQVLRGPYSQDLSYEALTMNVLKSFRTSATTFDQAAGRVVEVNIRSGHHVDAIRFFYDHLAGIMAGNSGGGTSHQVDVRGRLIQDLRMEFSHDILAALQLHFQDGTSTRKFGNELGWASRVLTCTAPYGYSLSSWGFRQDEGPYRTAAISVLRFQFAPDLDFPVPEEYM

SEQ ID NO: 491 - protein, 478 aa, Adiantum aethiopicum
MQAAAAVKGQELPVVDLIDKYMQVQAHDWHNRIRGAILGLISLVPVVGRGVSKLVGLFWPTTKVDIWEALKMEQYIRNIVQQEIFEFEMRLLQSDIAALETTVGRYDRATSLIEKGNFLSIWITQADALYFRMRDSTNNIHLLLHIVTVSTLHIAALHERLTFGEELYGTNNAANWTRDLVDKFRLYTVDLLPSIFRRWKVWREAQIEIRAWIDWGSCGNLSCRPNVSHATVRDKVSGVVLAFRAQNRASTTIFSGLCEGHKTRMQNEAVADMASCLSPTFAFHKLLPDNIQAQFSAFDREQFGQVFRGPYSQDLSYEALTMNVLKSFITSPTTFDHTVGRVLEVNIRSGHHVDAIRFWYGHLDSNSMTPGIMGGNSGGGTSHQVDVRGRLIQDLRMEFSHDILAALQLHFQDGTFTRKFGNELGWASRVLTCTAPYGYRLSSWAFRQDEGPYRTAAISVLRFQFTPELDFPVPEEYM

SEQ ID NO: 492 - protein, 427 aa, Tectaria cicutaria
MQIEAHDWHNRGSYPQYQRNIVKQEIFEQEMRQHHSEIEALEAAIARYDTAAITEKGNFLSIWIWQADRLSISLRNSTNNIHLLLHIVTVAVLHMAAMHERLTFGEELYGTNNTADWSRDLVSVFKMYTINLIPRLFREWRQWRESQIEIKEWAVRGAWGNLVQRPDVPHATVEDKISGEMFTFQEQRLHSTTVFSAVCQDHKTRMSNEAVADMASCMSPTFAFHMLLPKDSQARFSPYNRELFDRVFRGPYSEDLLRPRSTSGRVFRSRATLFDRSDRDRILQVIVRAGSHVDAIQFIYDHMDPNSVTAGTMASNPNGGSRHQVDVRNRRIQDLRLEFARGVLASVQLHFDDGTSTRKLGDEWGFAAHTATCSTPPGYKLRSWAFREDPGPYSSTAISVLRFEFNPVEEDPRPSLDLSIFWIGQLN

SEQ ID NO: 493 - protein, 414 aa, Tectaria cicutaria
MQIEAHDWHNRGSYPQYQRNIVKQEIFEQEMCQHHSEIEALEAAIARYDTAAITEKGNFLSIWIWQADRLSISLRNSTNNIHLLLHIVTVAVLHMAAMHERLTFGEELYGTNNTADWSRDLVSVFKMYTINLIPRLFREWRQWRESQIEIKEWAVRGAWGNLVQRPDVSHATVEDKISGEMFTFQEQRLHSTTVFSAVCQDHKTRMSNEAVADMASCMSPTFAFHMLLPKDSQARFSPYNRELFDRVFRGPYSEDLLRPRSTSGRVFRSRATLFDRSDRDRILQVIVRAGSHVDAIQFIYDHMDPNSVTAGTMASNPNGGSRHQVDVRNRRIQDLRLEFARGVLASVQLHFDDGTSTRKLGDEWGFAAHTATCSTPPGYKLRSWAFREDPGPYSSTAISVLRFEFNPVEEDPPS

SEQ ID NO: 494 - protein, 414 aa, Tectaria cicutaria
MQIEAHDWHNRGSYPQYQRNIVKQEIFEQEMRQHHSEIEALEAAIARYDTAAITEKGNFLSIWIWQADRLSISLRNSTNNIHLLLHIVTVAVLHMAAMHERLTFGEELYGTNNTADWSRDLVSVFKMYTINLIPRLFREWRQWRESQIEIKEWAVRGAWGNLVQRPDVSHATVEDKISGEMFTFQEQRLHSTTVFSAVCQDHKTRMSNEAVADMASCMSPTFAFHMLLPKDSQARFSPYNRELFDRVFRGPYSEDLLRPRSTSGRVFRSRATLFDRSDRDRILQVIVRAGSHVDAIQFIYDHMDPNSVTAGTMASNPNGGSRHQVDVRNRRIQDLRLEFARGVLASVQLHFDDGTSTRKLGDEWGFAAHTATCSTPPGYKLRSWAFREDPGPYSSTAISVLRFEFNPVEEDPPS

SEQ ID NO: 495 - protein, 496 aa, Dryopteris hondoensis
MAAPGIKDDVNPASVIAPTAEEVQHDELVIMKAQQNDVDLLSKNNLQIEAHDWHNRARSAILMLISVIPTVGAAISFVVGLFWPVNQVDIWEAIEGAVRNIVQQEIFAFELQQLESDIQGLQTVVRRYDRAGGLTERGNFLSNWITQADNLSIRLRNSPNNIHLLLHIVTVAVLHVAALHERLTFGEELYGINHTASWKQDLVDKIKLYTSDVVPNIFNKWKPWREDQIEITEWGRNAQHGNLNYRPASSHARVEDKISGEIITFQVTGQNSTTIFSGVCQDHKTRMVNEATADMASCMSPTFVFHKLLPHDVQAQLSPYDEVFRRVFRGPYSQDLLRQSFTSLKSFRSHPTRFDQTARDRILEVIIRAGSLVDAIQFWYDNVWNPNTMTAGTMAGNPSGGASHRFDLRGRSIQDFHMTFANDVLTSLRLRFGDGTSTQTFGTEGWPASNTATCTAPYGYRLSSWAFREDLGPFNSTAISLLRFQFTPELDDIPLP

SEQ ID NO: 496 - protein, 493 aa, Dryopteris hondoensis
MAAPGIKDDVNPASVIAPTAEEDELVIMKAQQNDVDLLSKNNLQIEAHDWHNRARSAILMLISVIPTVGAAISFVVGLFWPVNQVDIWEAIEGAVRNIVQQEIFAFELQQLESDIQGLQTVVRRYDRAGGLTERGNFLSNWITQADNLSIRLRNSPNNIHLLLHIVTVAVLHVAALHERLTFGEELYGINHTASWKQDLVDKIKLYTSDVVPNIFNKWKPWREDQIEITEWGRNAQHGNLNYRPASSHARVEDKISGEIITFQVTGQNSTTIFSGVCQDHKTRMVNEATADMASCMSPTFVFHKLLPHDVQAQLSPYDEVFRRVFRGPYSQDLLRQSFTSLKSFRSHPTRFDQTARDRILEVIIRAGSLVDAIQFWYDNVWNPNTMTAGTMAGNPSGGASHRFDLRGRSIQDFHMTFANDVLTSLRLRFGDGTSTQTFGTEGWPASNTATCTAPYGYRLSSWAFREDLGPFNSTAISLLRFQFTPELDDIPLP

That which is claimed is:

1. A recombinant polypeptide comprising an insecticidal amino acid sequence having at least 90% sequence identity to SEQ ID NO: 16, and a heterologous signal sequence, a histidine tag, or heterologous transit sequence operably linked to said insecticidal amino acid sequence.

2. The recombinant polypeptide of claim 1, wherein said recombinant polypeptide is insecticidal against a Lepidopteran agricultural pest.

3. The recombinant polypeptide of claim 1, wherein said heterologous signal sequence, histidine tag, or heterologous transit sequence is operably linked to the N-terminus of the insecticidal amino acid sequence.

4. The recombinant polypeptide of claim 1, wherein said insecticidal amino acid sequence has at least 98% sequence identity to SEQ ID NO: 16.

5. An agricultural composition comprising at least one recombinant polypeptide of claim 1.

6. A recombinant polynucleotide comprising
a nucleic acid encoding a recombinant polypeptide that comprises an insecticidal amino acid sequence having at least 90% sequence identity to SEQ ID NO: 16; and
a heterologous regulatory element, wherein said heterologous regulatory element is operably linked to the nucleic acid encoding said recombinant polypeptide.

7. The recombinant polynucleotide of claim 6, wherein the heterologous regulatory element is a promoter.

8. The recombinant polynucleotide of claim 6, wherein the nucleic acid encoding said recombinant polypeptide comprises codons optimized for expression in plants.

9. The recombinant polynucleotide of claim 6, wherein the nucleic acid encoding said recombinant polypeptide is a cDNA.

10. A recombinant polynucleotide encoding the recombinant polypeptide of claim 1.

11. A DNA construct comprising the recombinant polynucleotide of claim 10.

12. A transgenic plant comprising the recombinant polynucleotide of claim 6.

13. A transgenic plant comprising the DNA construct of claim 11.

14. A method of inhibiting growth or killing an insect pest or pest population comprising contacting the insect pest with the recombinant polypeptide of claim 1.

15. A method of controlling insect pest damage to plants comprising providing the transgenic plant of claim 12 to said insect pest or pest population for ingestion.

16. A method of inhibiting growth or killing an insect pest or pest population comprising expressing in a transgenic plant the recombinant polynucleotide of claim 6 and exposing said insect pest or pest population to said transgenic plant.

17. A method for controlling an insect pest infestation comprising providing in the diet of the pest the transgenic plant of claim 13 or a part thereof.

18. A method for improving the yield of a crop comprising growing the transgenic plant of claim 13, wherein the yield of the crop is increased in the presence of an insect pest relative to the crop not comprising said transgenic plant.

19. The method of claim 15, wherein the transgenic plant is selected from corn, soybean, wheat, rice, sorghum, sunflower, canola, barley, sugarcane, potatoes, tomatoes, cotton, rape seed, peanut, and alfalfa.

20. The method of claim 14, wherein the insect pest or insect pest population is in the Order Lepidopteran.

21. The method of claim 20, wherein the insect pest or insect pest population is corn earworm, European corn borer, fall armyworm, soybean looper, and velvet bean caterpillar.

* * * * *